(12) United States Patent
Raitano et al.

(10) Patent No.: US 7,553,814 B2
(45) Date of Patent: Jun. 30, 2009

(54) 238P1B2 PROTEIN

(75) Inventors: Arthur B. Raitano, Los Angeles, CA (US); Pia M. Challita-Eid, Encino, CA (US); Mary Faris, Los Angeles, CA (US); Rene S. Hubert, Los Angeles, CA (US); Robert Kendall Morrison, Santa Monica, CA (US); Wangmao Ge, Los Angeles, CA (US); Aya Jakobovits, Beverly Hills, CA (US)

(73) Assignee: Agensys, Inc., Santa Monica, CA (US)

( * ) Notice: Subject to any disclaimer, the term of this patent is extended or adjusted under 35 U.S.C. 154(b) by 498 days.

(21) Appl. No.: 11/483,302

(22) Filed: Jul. 6, 2006

(65) Prior Publication Data

US 2007/0015704 A1 Jan. 18, 2007

Related U.S. Application Data

(63) Continuation of application No. 10/114,669, filed on Apr. 1, 2002, now abandoned.

(51) Int. Cl.
*A61K 38/17* (2006.01)
*A61K 39/00* (2006.01)

(52) U.S. Cl. ........................................................ 514/12

(58) Field of Classification Search ........................ None
See application file for complete search history.

(56) References Cited

FOREIGN PATENT DOCUMENTS

| EP | 1 270 724 | 1/2003 |
|---|---|---|
| WO | WO-01/27158 | 4/2001 |
| WO | WO-02/16548 | 2/2002 |

OTHER PUBLICATIONS

Database EMBL, Accession No. Q8VH15 (2002).
Database NCBI, Accession No. ac090719 (2002).
Futcher et al., Mol. Cell. Biol. (1999) 19:7357-7368.
Gygi et al., Mol. Cell. Biol. (1999) 19:1720-1730.
Haynes et al., Electrophoresis (1998) 19:1862-1871.
Hopp et al., PNAS USA (1981) 78(6):3824-3828.
International Search Report for PCT/US02/10132, mailed on Apr. 6, 2005, 3 pages.
Koivunen et al., Journal of Biological Chemistry (1993) 268:20205-20210.
Ohara et al., Nucleic Acids Research (2001) 29(4):e22 p. 1-8.
Reiter et al., PNAS USA (1998) 95:1735-1740.
Schmittgen et al., Int. J. Cancer (2003) 107:323-329.
Supplementary Partial European Search Report for EP 02728645.9, mailed on Feb. 10, 2006, 8 pages.
Supplementary Partial European Search Report for EP 02728645.9, mailed on May 12, 2006, 10 pages.

*Primary Examiner*—Daniel E. Kolker
(74) *Attorney, Agent, or Firm*—Morrison & Foerster LLP

(57) ABSTRACT

A novel gene (designated 238P1B2) and its encoded protein, and variants thereof, are described wherein 238P1B2 exhibits tissue specific expression in normal adult tissue, and is aberrantly expressed in the cancers listed in Table I. Consequently, 238P1B2 provides a diagnostic, prognostic, prophylactic and/or therapeutic target for cancer. The 238P1B2 gene or fragment thereof, or its encoded protein, or variants thereof, or a fragment thereof, can be used to elicit a humoral or cellular immune response; antibodies or T cells reactive with 238P1B2 can be used in active or passive immunization.

3 Claims, 48 Drawing Sheets

Figure 1. 238P1B2 SSH sequence of 210 nucleotides (SEQ ID:8869)

```
  1 GATCAATACA CAAATGAATG TAGCTTTTTT TGTTTAAGCT CTCATCTCGT TCTGTACTTT
 61 TAATTCATCA CGTCAACTTT GCAGAATATC ACCTCCACTT CCATCATTTT CCTGCTCACT
121 GGTGTTCCTG GGCTGGAAGC CTTCCACACC TGGATCTCCA TTCCCTTCTG CTTCCTCTCT
181 GTAACTGCTC TCTTGGGAAA CAGCCTGATC
```

Figure 2A. The cDNA (SEQ ID:8870) and amino acid sequence (SEQ ID:8871) of
238P1B2 v.1A clone A. The start methionine is underlined. The open reading frame extends
from nucleic acid 2133-2897 including the stop codon.

```
   1 ccgccttccaggttcactccattctcctgcctcagcctccccagtagctggaactacagg
  61 cgcccgccaccacgcccggctaattttttgtattttagtggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctcttttctggt
 361 aattccttttagtgtgttttggttttcaaaatcatttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttcatttctttgtg
 541 ctgtgaacatttaaaattctctcttttagttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgttttcatctagttttctgttaattttagttaaatcaca
 781 cccccaccccccttttttttcactaagacttcttccggtgatccttgaggtgacactt
 841 tatcagggtgaatgtgtgagtctggatacgttgaggttcctctccatcctctcttttgtc
 901 aacacttactgtcagccacccagcacccttttttcctctgaagaagttaccctgcaac
 961 tggctctctcttgattgagccctctgcagccacaaccctaatctctgttttccta
1021 gaccccgtcttcaactcaaccatacccatctatctacctttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctggtgggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tatttctggcttcccaaattgtctgtaagcttctctgctttccacacttatgaccaatg
1501 taatattgctgttccacagccccagtgtattttctctggtgccaaccatagaggaaaaa
1561 taatgcactacctctttagcacaatttaaacatgccataaagaatgaaatatgattggca
1621 aactcagggtaaagtgttttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattatataaatactcatcagttttctg
1861 tacaataaaattattttaattcgatcaatacacaaatgaatgtagcttttttttgtttaa
1921 gctctcatctcgttctgtacttttaattcatcacgtcaactttgcagaatatcacctcca
1981 cttccatcattttcctgctcactggtgttcctgggctggaagccttccacacctggatct
2041 ccattccttctgcttcctctctgtaactgctctcttgggaaacagcctgatcctcttcg
```

```
         1                              M  Y  Y  F  L  S  M  L  S  A
2101 ctaccatcactcagcccagcctccacgaaccaATGTACTATTTCCTCTCCATGCTGTCCG
    11  T  D  L  G  L  S  I  S  T  L  V  T  M  L  S  I  F  W  N
```

Figure 2A-2

```
2161 CCACTGACCTCGGCCTGTCCATATCCACTCTGGTCACCATGCTGAGTATATTCTGGTTCA
  31     V  R  E  I  S  F  N  A  C  L  S  H  M  F  F  I  K  F  F  T
2221 ATGTGAGGGAAATCAGCTTTAATGCCTGCTTGTCCCACATGTTCTTTATTAAATTCTTCA
  51     V  M  E  S  S  V  L  L  A  M  A  F  D  R  F  V  A  V  S  N
2281 CTGTCATGGAATCCTCAGTGCTGTTGGCCATGGCTTTTGATCGTTTTGTGGCCGTCTCTA
  71     P  L  R  Y  A  M  I  L  T  D  S  R  I  A  Q  I  G  V  A  S
2341 ATCCCCTTAGGTATGCCATGATTTTAACTGACTCCAGAATAGCTCAAATTGGAGTGGCAA
  91     V  I  R  G  L  L  M  L  T  P  M  V  A  L  L  I  R  L  S  Y
2401 GTGTCATCAGGGGGCTCCTAATGCTGACACCAATGGTAGCACTTCTTATAAGACTTTCCT
 111     C  H  S  Q  V  L  H  H  S  Y  C  Y  H  P  D  V  M  K  L  S
2461 ACTGCCACAGCCAAGTACTCCACCACTCCTACTGCTACCACCCTGATGTGATGAAGCTCT
 131     C  T  D  T  R  I  N  S  A  V  G  L  T  A  M  F  S  T  V  G
2521 CATGCACAGACACCAGAATCAACAGTGCAGTTGGGCTGACTGCCATGTTCTCTACTGTTG
 151     V  D  L  L  I  L  L  S  Y  V  L  I  I  R  T  V  L  S  V
2581 GTGTAGACTTACTTCTCATCCTCCTTTCTTATGTTTTGATCATTAGGACTGTCCTTAGCG
 171     A  S  P  E  E  R  K  E  T  F  S  T  C  V  S  H  I  V  A  F
2641 TTGCTTCCCCAGAAGAGAGGAAGGAAACCTTCAGTACATGTGTCTCCCACATTGTGGCTT
 191     A  I  Y  Y  I  P  L  I  S  L  S  I  V  H  R  F  G  K  Q  A
2701 TTGCTATATATTACATTCCATTGATCAGTCTGTCCATTGTTCACAGATTTGGGAAACAAG
 211     P  A  Y  V  H  T  M  I  A  N  T  Y  L  L  I  S  P  L  M  N
2761 CCCCAGCCTATGTACATACTATGATTGCTAACACCTACCTGCTGATCTCCCCTTTGATGA
 231     P  V  I  Y  S  V  K  T  K  Q  I  R  R  A  V  I  K  I  L  H
2821 ACCCTGTCATCTACAGTGTGAAAACCAAACAGATACGTAGAGCTGTGATAAAAATTCTCC
 251     S  K  E  T  *
2881 ATTCCAAAGAAACATAAaattgtagaattctagcactagatggacccctcaagatggtat
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagccttatatataaaatttctccttctcacaccactgttgggtccaaactgttgtt
3181 gccttctgtccctgccaacacccttctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgtttttt
3361 gtatgtattaacatattttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtcccccacactcttaattta
3541 atgttatattgctacctataatataatatataggtatataatttatatataatttatatt
3601 tgtaaaaattatatgaacttatatatataaacttatatttataaattatgtacttatatg
3661 tgtaaattatatttatatttataaatataaatatagagagaagttcaggcaattttttact
3721 aggaaacataaagaagtaaaaaaaaaaaaaaaaaaa
```

Figure 2B. The cDNA (SEQ ID. NO.:8872) and amino acid sequence (SEQ ID. NO.:8873) of 238P1B2 v.1B clone A. The open reading frame extends from nucleic acid 1947-2897 including the stop codon.

```
   1 ccgccttccaggttcactccattctcctgcctcagcctccccagtagctggaactacagg
  61 cgcccgccaccacgcccggctaattttttgtattttttagtggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctcttctggt
 361 aattccttttagtgtgttttggttttcaaaatcattttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttcatttctttgtg
 541 ctgtgaacatttaaaattctctcttttagtttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgttttcatctagttttctgttaattttagttaaatcaca
 781 cccccacccccctttttttttcactaagacttcttccggtgatccttgaggtgacactt
 841 tatcagggtgaatgtgtgagtctggatacgttgaggttcctctccatcctctcttttgtc
 901 aacttactgtcagccacccagcacccttcttttcctctgaagaagttaccctgcaac
 961 tggctctctcattgattgagccctctgcagccacaaccctaatctctgttttttcccta
1021 gaccccgtcttcaactcaaccatacccatctatctaccttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctggtggggaggtctgtgttctaacca
1321 tctcttccaaatatgatgccgggtatcatattgtaagggtttctttaatggttagatgct
1381 gaagccatttatttgtcacttcctatgtgttactttgtattataatgatctcttctttcttca
1441 tatttctggcttcccaaattgtctgtaagcttctctgctttccacacttatgaccaatg
1501 taatattgctgttccacagcccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattatataaatactcatcagttttctg
1861 tacaataaaattattttaattcgatcaatacacaaatgaatgtagctttttttgtttaa
```

```
   1                                    F  I  T  S  T  L  Q  N  I  T  S  T
1921 gctctcatctcgttctgtacttttaaTTCATCACGTCAACTTTGCAGAATATCACCTCCA
  13    S  I  I  F  L  L  T  G  V  P  G  L  E  A  F  H  T  W  I  S
1981 CTTCCATCATTTTCCTGCTCACTGGTGTTCCTGGGCTGGAAGCCTTCCACACCTGGATCT
  33    I  P  F  C  F  L  S  V  T  A  L  L  G  N  S  L  I  L  F  A
```

Figure 2B-2

```
2041 CCATTCCCTTCTGCTTCCTCTCTGTAACTGCTCTCTTGGGAAACAGCCTGATCCTCTTCG
  53   T  I  T  Q  P  S  L  H  E  P  M  Y  Y  F  L  S  M  L  S  A
2101 CTACCATCACTCAGCCCAGCCTCCACGAACCAATGTACTATTTCCTCTCCATGCTGTCCG
  73   T  D  L  G  L  S  I  S  T  L  V  T  M  L  S  I  F  W  F  N
2161 CCACTGACCTCGGCCTGTCCATATCCACTCTGGTCACCATGCTGAGTATATTCTGGTTCA
  93   V  R  E  I  S  F  N  A  C  L  S  H  M  F  F  I  K  F  F  T
2221 ATGTGAGGGAAATCAGCTTTAATGCCTGCTTGTCCCACATGTTCTTTATTAAATTCTTCA
 113   V  M  E  S  S  V  L  L  A  M  A  F  D  R  F  V  A  V  S  N
2281 CTGTCATGGAATCCTCAGTGCTGTTGGCCATGGCTTTTGATCGTTTTGTGGCCGTCTCTA
 133   P  L  R  Y  A  M  I  L  T  D  S  R  I  A  Q  I  G  V  A  S
2341 ATCCCCTTAGGTATGCCATGATTTTAACTGACTCCAGAATAGCTCAAATTGGAGTGGCAA
 153   V  I  R  G  L  L  M  L  T  P  M  V  A  L  L  I  R  L  S  Y
2401 GTGTCATCAGGGGGCTCCTAATGCTGACACCAATGGTAGCACTTCTTATAAGACTTTCCT
 173   C  H  S  Q  V  L  H  H  S  Y  C  Y  H  P  D  V  M  K  L  S
2461 ACTGCCACAGCCAAGTACTCCACCACTCCTACTGCTACCACCCTGATGTGATGAAGCTCT
 193   C  T  D  T  R  I  N  S  A  V  G  L  T  A  M  F  S  T  V  G
2521 CATGCACAGACACCAGAATCAACAGTGCAGTTGGGCTGACTGCCATGTTCTCTACTGTTG
 213   V  D  L  L  L  I  L  L  S  Y  V  L  I  I  R  T  V  L  S  V
2581 GTGTAGACTTACTTCTCATCCTCCTTTCTTATGTTTTGATCATTAGGACTGTCCTTAGCG
 233   A  S  P  E  E  R  K  E  T  F  S  T  C  V  S  H  I  V  A  F
2641 TTGCTTCCCCAGAAGAGAGGAAGGAAACCTTCAGTACATGTGTCTCCCACATTGTGGCTT
 253   A  I  Y  Y  I  P  L  I  S  L  S  I  V  H  R  F  G  K  Q  A
2701 TTGCTATATATTACATTCCATTGATCAGTCTGTCCATTGTTCACAGATTTGGGAAACAAG
 273   P  A  Y  V  H  T  M  I  A  N  T  Y  L  L  I  S  P  L  M  N
2761 CCCCAGCCTATGTACATACTATGATTGCTAACACCTACCTGCTGATCTCCCCTTTGATGA
 293   P  V  I  Y  S  V  K  T  K  Q  I  R  R  A  V  I  K  I  L  H
2821 ACCCTGTCATCTACAGTGTGAAAACCAAACAGATACGTAGAGCTGTGATAAAAATTCTCC
 313   S  K  E  T  *
2881 ATTCCAAAGAAACATAAaattgtagaattctagcactagatggacccctcaagatggtat
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagccttatatataaaattttctccttctcacaccactgttgggtccaaactgttgtt
3181 gccttctgtccctgccaacacccttttctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgtttttt
3361 gtatgtattaacatatttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtcccccacactcttaattttta
3541 atgttatattgctacctataatataatatataggtatataatttatatataatttatatt
3601 tgtaaaaattatatgaacttatatatataaacttatatttataaaattatgtacttatatg
```

Figure 2B-3

```
3661 tgtaaattatatttatatttataaatataaatatagagagaagttcaggcaattttttact
3721 aggaaacataaagaagtaaaaaaaaaaaaaaaa
```

Figure 2C. The cDNA (SEQ ID. NO.:8874) and amino acid sequence (SEQ ID. NO.:8875) of 238P1B2 v.2. The start methionine is underlined. The open reading frame extends from nucleic acid 2133-2897 including the stop codon.

```
   1 ccgccttccaggttcactccattctcctgcctcagcctcccagtagctggaactacagg
  61 cgcccgccaccacgcccggctaattttttgtattttagtggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctctttctggt
 361 aattcctttttagtgtgttttggttttcaaaatcattttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttatcatttctttgtg
 541 ctgtgaacatttaaaattctctcttttagttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgttttcatctagttttctgttaattttagttaaatcaca
 781 ccccaccccccttttttttcactaagacttcttccggtgatccttgaggtgacactt
 841 tatcagggtgaatgtgtgagtctggatacgttgaggttcctctccatcctctcttttgtc
 901 aacacttactgtcagccacccagcacccttttcttttcctctgaagaagttaccctgcaac
 961 tggctctctcattgattgagccctctgcagccacaaccctaatctctgttttcccta
1021 gaccccgtcttcaactcaaccatacccatctatctaccttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctggtgggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tattttctggcttcccaaattgtctgtaagcttctctgctttccacacttatgaccaatg
1501 taatattgctgttccacagccccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattatataaatactcatcagttttctg
1861 tacaataaaattattttaattcgatcaatacacaaatgaatgtagcttttttttgtttaa
1921 gctctcatctcgttctgtacttttaattcatcacgtcaactttgcagaatatcacctcca
1981 cttccatcatttcctgctcactggtgttcctgggctggaagccttccacacctggatct
2041 ccattcccttctgcttcctctctgtaactgctctcttgggaaacagcctgatcctcttcg
```

```
   1                                         M  Y  Y  F  L  S  M  L  S  A
2101 ctaccatcactcagcccagcctccacgaaccaATGTACTATTTCCTCTCCATGCTGTCCG
```

Figure 2C-2

```
  11           T   D   L   G   L   S   I   S   T   L   V   T   M   L   S   I   F   W   N
2161 CCACTGACCTCGGCCTGTCCATATCCACTCTGGTCACCATGCTGAGTATATTCTGGTTCA
  31           V   R   E   I   S   F   N   A   C   L   S   H   M   F   F   I   K   F   F   T
2221 ATGTGAGGGAAATCAGCTTTAATGCCTGCTTGTCCCACATGTTCTTTATTAAATTCTTCA
  51           V   M   E   S   S   V   L   L   A   M   A   F   D   R   F   V   A   V   S   N
2281 CTGTCATGGAATCCTCAGTGCTGTTGGCCATGGCTTTTGATCGTTTTGTGGCCGTCTCTA
  71           P   L   R   Y   A   M   I   L   T   D   S   R   I   A   Q   I   G   V   A   S
2341 ATCCCCTTAGGTATGCCATGATTTTAACTGACTCCAGAATAGCTCAAATTGGAGTGGCAA
  91           V   I   R   G   L   L   M   L   T   P   M   V   A   L   L   I   R   L   S   Y
2401 GTGTCATCAGGGGGCTCCTAATGCTGACACCAATGGTAGCACTTCTTATAAGACTTTCCT
 111           C   H   S   Q   V   L   H   S   Y   C   Y   H   P   D   V   M   K   L   S
2461 ACTGCCACAGCCAAGTACTCCACCACTCCTACTGCTACCACCCTGATGTGATGAAGCTCT
 131           C   T   D   T   R   I   N   S   A   V   G   L   T   A   M   F   S   T   V   G
2521 CATGCACAGACACCAGAATCAACAGTGCAGTTGGGCTGACTGCCATGTTCTCTACTGTTG
 151           V   D   L   L   L   I   L   L   S   Y   V   L   I   I   R   T   V   L   S   V
2581 GTGTAGACTTACTTCTCATCCTCCTTTCTTATGTTTTGATCATTAGGACTGTCCTTAGCG
 171           A   S   P   E   E   R   K   E   T   F   S   T   C   V   S   H   I   V   A   F
2641 TTGCTTCCCCAGAAGAGAGGAAGGAAACCTTCAGTACATGTGTCTCCCACATTGTGGCTT
 191           A   I   Y   Y   I   P   L   I   S   L   S   I   V   H   R   F   G   K   Q   A
2701 TTGCTATATATTACATTCCATTGATCAGTCTGTCCATTGTTCACAGATTTGGGAAACAAG
 211           P   A   Y   V   H   T   M   I   A   N   T   Y   L   L   T   S   P   L   M   N
2761 CCCCAGCCTATGTACATACTATGATTGCTAACACCTACCTGCTGACCTCCCCTTTGATGA
 231           P   V   I   Y   S   V   K   T   K   Q   I   R   R   A   V   I   K   I   L   H
2821 ACCCTGTCATCTACAGTGTGAAAACCAAACAGATACGTAGAGCTGTGATAAAAATTCTCC
 251           S   K   E   T   *
2881 ATTCCAAAGAAACATAAaattgtagaattctagcactagatggaccccctcaagatggtat
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagccttatatataaaatttctccttctcacaccactgttgggtccaaactgttgtt
3181 gccttctgtccctgccaacacccttctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgttttttt
3361 gtatgtattaacatattttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtcccccacactcttaatttta
3541 atgttatattgctacctataatataatatataggtatataatttatatataatttatatt
3601 tgtaaaaattatatgaacttatatatataaacttatatttataaattatgtacttatatg
3661 tgtaaattatatttatatttataaatataaatatagagagaagttcaggcaattttttact
3721 aggaaacataaagaagtaaaaaaaaaaaaaaaaa
```

Figure 2D. The cDNA (SEQ ID. NO.:8876) and amino acid sequence (SEQ ID. NO.:8877) of 238P1B2 v.3. The start methionine is underlined. The open reading frame extends from nucleic acid 2133-2897 including the stop codon.

```
   1 ccgccttccaggttcactccattctcctgcctcagcctccccagtagctggaactacagg
  61 cgcccgccaccacgcccggctaattttttgtattttagtggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctctttctggt
 361 aattcctttttagtgtgttttggttttcaaaatcattttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttatcatttctttgtg
 541 ctgtgaacatttaaaattctctcttttagttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgttttcatctagttttctgttaattttagttaaatcaca
 781 cccccaccccccttttttttcactaagacttcttccggtgatccttgaggtgacactt
 841 tatcagggtgaatgtgtgagtctggatacgttgaggttcctctccatcctctcttttgtc
 901 aacacttactgtcagccacccagcacccttttcttttcctctgaagaagttaccctgcaac
 961 tggctctctcattgattgagccctctgcagccacaaccctaatctctgttttccta
1021 gaccccgtcttcaactcaaccatacccatctatctacctttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctggtgggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tattttctggcttcccaaattgtctgtaagcttctctgctttccacacttatgaccaatg
1501 taatattgctgttccacagccccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattatataaatactcatcagttttctg
1861 tacaataaaattattttaattcgatcaatacacaaatgaatgtagcttttttttgtttaa
1921 gctctcatctcgttctgtacttttaattcatcacgtcaactttgcagaatatcacctcca
1981 cttccatcattttcctgctcactggtgttcctgggctggaagccttccacacctggatct
2041 ccattcccttctgcttcctctctgtaactgctctcttgggaaacagcctgatcctcttcg
   1                                                  M  Y  Y  F  L  S  M  L  S  A
```

Figure 2D-2

```
2101 ctaccatcactcagcccagcctccacgaaccaATGTACTATTCCTCTCCATGCTGTCCG
  11                                  T  Y  Y  S  S  P  C  P
2161 CCACTGACCTCGGCCTGTCCATATCCACTCTGGTCACCATGCTGAGTATATTCTGGTTCA
  31    T  D  L  G  L  S  I  S  T  L  V  T  M  L  S  I  F  W  F  N
2221 ATGTGAGGGAAATCAGCTTTAATGCCTGCTTGTCCCACATGTTCTTTATTAAATTCTTCA
  51    V  R  E  I  S  F  N  A  C  L  S  H  M  F  F  I  K  F  F  T
2281 CTGTCATGGAATCCTCAGTGCTGTTGGCCATGGCTTTTGATCGTTTTGTGGCCGTCTCTA
  71    V  M  E  S  S  V  L  L  A  M  A  F  D  R  F  V  A  V  S  N
2341 ATCCCCTTAGGTATGCCATGATTTTAACTGACTCCAGAATAGCTCAAATTGGAGTGGCAA
  91    P  L  R  Y  A  M  I  L  T  D  S  R  I  A  Q  I  G  V  A  S
2401 GTGTCATCAGGGGGCTCCTAATGCTGACACCAATGGTAGCACTTCTTATAAGACTTTCCT
 111    V  I  R  G  L  L  M  L  T  P  M  V  A  L  L  I  R  L  S  Y
2461 ACTGCCACAGCCAAGTACTCCACCACTCCTACTGCTACCACCCTGATGTGATGAAGCTCT
 131    C  H  S  Q  V  L  H  H  S  Y  C  Y  H  P  D  V  M  K  L  S
2521 CATGCACAGACACCAGAATCAACAGTGCAGTTGGGCTGACTGCCATGTTCTCTACTGTTG
 151    C  T  D  T  R  I  N  S  A  V  G  L  T  A  M  F  S  T  V  G
2581 GTGTAGACTTACTTCTCATCCTCCTTTCTTATGTTTTGATCATTAGGACTGTCCTTAGCG
 171    V  D  L  L  L  I  L  L  S  Y  V  L  I  I  R  T  V  L  S  V
2641 TTGCTTCCCCAGAAGAGAGGAAGGAAACCTTCAGTACATGTGTCTCCCACATTGTGGCTT
 191    A  S  P  E  E  R  K  E  T  F  S  T  C  V  S  H  I  V  A  F
2701 TTGCTATATATTACATTCCATTGATCAGTCTGTCCATTGTTCACAGATTTGGGAAACAAG
 211    A  I  Y  Y  I  P  L  I  S  L  S  I  V  H  R  F  G  K  Q  A
2761 CCCCAGCCTATGTACATACTATGATTGCTAACACCTACCTGCTGATCTCCCCTTTGATGA
 231    P  A  Y  V  H  T  M  I  A  N  T  Y  L  L  I  S  P  L  M  N
2821 ACCCTGTCATCTACAGTGTGAAAACCAAACAGATACGTAGAGCTGTGATAAAAATTCTCC
 251    P  V  I  Y  S  V  K  T  K  Q  I  R  R  A  V  I  K  I  L  H
2881 ATTCCAAAGAAACATAAaattgtagaattctagcactagatggacccctcaagatggtat
 271    S  K  E  T  *
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagccttatatataaaatttctccttctcacaccactgttgggtccaaactgttgtt
3181 gccttctgtccctgccaacacccctttctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgttttttt
3361 gtatgtattaacatatttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtcccccacactcttaattttta
3541 atgttatattgctacctataatataatatataggtatataatttatatataatttatatt
3601 tgtaaaaattatatgaacttatatatataaacttatatttataaattatgtacttatatg
3661 tgtaaattatatttatatttataaatataaatatagagagaagttcaggcaattttttact
3721 aggaaacataaagaagtaaaaaaaaaaaaaaaaa
```

Figure 2E. The cDNA (SEQ ID:8878) and amino acid sequence (SEQ ID:8879) of 238P1B2 v.4. The start methionine is underlined. The open reading frame extends from nucleic acid 2133-2897 including the stop codon.

```
   1 ccgccttccaggttcactccattctcctgcctcagcctccccagtagctggaactacagg
  61 cgcccgccaccacgcccggctaattttttgtattttagtgggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctctttctggt
 361 aattcctttttagtgtgttttggttttttcaaaatcattttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttatcatttctttgtg
 541 ctgtgaacatttaaaattctctcttttagttttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgtttttcatctagttttctgttaattttagttaaatcaca
 781 cccccacccccttttttttttcactaagacttcttccggtgatccttgaggtgacactt
 841 tatcagggtgaatgtgtgagtctggatacgttgaggttcctctccatcctctcttttgtc
 901 aacacttactgtcagccacccagcaccctttcttttcctctgaagaagttaccctgcaac
 961 tggctctctctcattgattgagccctctgcagccacaaccctaatctctgtttttcccta
1021 gaccccgtcttcaactcaaccatacccatctatctaccttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctgggggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tatttctggcttcccaaattgtctgtaagcttctctgctttccacacttatgaccaatg
1501 taatattgctgttccacagccccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattataaatactcatcagttttctg
1861 tacaataaaattattttaattcgatcaatacacaaatgaatgtagcttttttttgtttaa
1921 gctctcatctcgttctgtacttttaattcatcacgtcaactttgcagaatatcacctcca
1981 cttccatcattttcctgctcactggtgttcctgggctggaagccttccacacctggatct
2041 ccattccttctgcttcctctctgtaactgctctcttgggaaacagcctgatcctcttcg
   1                                          M  Y  Y  F  L  S  M  L  S  A
2101 ctaccatcactcagcccagcctccacgaacca<u>ATG</u>TACTATTTCCTCTCCATGCTGTCCG
```

Figure 2E-2

```
  11      T   D   L   G   L   S   I   S   T   L   V   T   M   L   S   I   F   W   F   N
2161 CCACTGACCTCGGCCTGTCCATATCCACTCTGGTCACCATGCTGAGTATATTCTGGTTCA
  31      V   R   E   I   S   F   N   A   C   L   S   H   M   F   F   I   K   F   F   T
2221 ATGTGAGGGAAATCAGCTTTAATGCCTGCTTGTCCCACATGTTCTTTATTAAATTCTTCA
  51      V   M   E   S   S   V   L   L   A   M   A   F   D   R   F   V   A   V   S   N
2281 CTGTCATGGAATCCTCAGTGCTGTTGGCCATGGCTTTTGATCGTTTTGTGGCCGTCTCTA
  71      P   L   R   Y   A   M   I   L   T   D   S   R   I   A   Q   I   G   V   A   S
2341 ATCCCCTTAGGTATGCCATGATTTTAACTGACTCCAGAATAGCTCAAATTGGAGTGGCAA
  91      V   I   R   G   L   L   M   L   T   P   M   V   A   L   L   I   R   L   S   Y
2401 GTGTCATCAGGGGGCTCCTAATGCTGACACCAATGGTAGCACTTCTTATAAGACTTTCCT
 111      C   H   S   Q   V   L   H   H   S   Y   C   Y   H   P   D   V   M   K   L   S
2461 ACTGCCACAGCCAAGTACTCCACCACTCCTACTGCTACCACCCTGATGTGATGAAGCTCT
 131      C   T   D   T   R   I   N   S   A   V   G   L   T   A   M   F   S   T   V   G
2521 CATGCACAGACACCAGAATCAACAGTGCAGTTGGGCTGACTGCCATGTTCTCTACTGTTG
 151      V   D   L   L   I   L   L   S   Y   V   L   I   I   R   T   V   L   S   V
2581 GTGTAGACTTACTTCTCATCCTCCTTTCTTATGTTTTGATCATTAGGACTGTCCTTAGCG
 171      A   S   P   E   E   R   K   E   T   F   S   T   C   V   S   H   I   V   A   F
2641 TTGCTTCCCCAGAAGAGAGGAAGGAAACCTTCAGTACATGTGTCTCCCACATTGTGGCTT
 191      A   I   Y   Y   I   P   L   I   S   L   S   I   V   H   R   F   G   K   Q   A
2701 TTGCTATATATTACATTCCATTGATCAGTCTGTCCATTGTTCACAGATTTGGGAAACAAG
 211      P   A   Y   V   H   T   M   I   A   N   T   Y   L   L   I   S   P   L   M   N
2761 CCCCAGCCTATGTACATACTATGATTGCTAACACCTACCTGCTGATCTCCCCTTTGATGA
 231      P   V   I   Y   S   V   K   T   K   Q   I   R   R   A   V   I   K   I   L   H
2821 ACCCTGTCATCTACAGTGTGAAAACCAAACAGATACGTAGAGCTGTGATAAAAATTCTCC
 251      S   K   E   T   *
2881 ATTCCAAAGAAACATAAaattgtagaattctagcactagatggacccctcaagatggtat
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagccttatatataaaatttctccttctcacaccactgttgggtccaaactgttgtt
3181 gccttctgtccctgccaacacccttcctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgtttttt
3361 gtatgtattaacatattttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtccccacactcttaatttta
3541 atgttatattgctacctataatataatatataggtatataatttatatataatttatatt
3601 tgtaaaaattatatgaacttatatatataaacttatatttataaattatgtacttatatg
3661 tgtaaattatatttatatttataaatataaatatagagagaagttcaggcaattttttact
3721 aggaaacataaagaagtaaaaaaaaaaaaaaaaaaa
```

Figure 2F. The cDNA (SEQ ID:8880) and amino acid sequence (SEQ ID:8881) of 238P1B2 v.5. The start methionine is underlined. The open reading frame extends from nucleic acid 2133-2897 including the stop codon.

```
   1 ccgccttccaggttcactccattctcctgcctcagcctccccagtagctggaactacagg
  61 cgccgccaccacgcccggctaattttttgtattttagtgggagacgaggtttcaccatg
 121 ttggccaggatggtctcgatctcctgacctcgtgatccgcccacctcggcctcccaaagt
 181 gctgggactacaggcgtgagccaccgcgcccagcctgctcaacacttttacacatgccgt
 241 tctgaaagcctgggaattcttcgtctcaacttatataaaacacagaaatctttcaagcac
 301 tgcttttctagaaagccttctccaaatactacaaacctactgaatgctctctttctggt
 361 aattccttttagtgtgttttggtttttcaaaatcattttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttatcatttctttgtg
 541 ctgtgaacatttaaaattctctcttttagttttttgaaatatactatacattaactata
 601 attcttatttctctaagaggtttgatcatacattttagatattttcatcactcgcctgag
 661 gacactgtcattactgtaaatttcagaatctaaagctatagtttcattatttggccaaat
 721 cgtgtaatctataatttcttgtttttcatctagttttctgttaattttagttaaatcaca
 781 cccccacccccctttttttttcactaagacttcttccggtgatccttgaggtgacactt
 841 tatcagggtgaatgtgtgagtctggatacgttgaggttcctctccatcctctcttttgtc
 901 aacacttactgtcagccacccagcacccttcttttcctctgaagaagttaccctgcaac
 961 tggctctctctcattgattgagccctctgcagccacaaccctaatctctgttttcccta
1021 gaccccgtcttcaactcaaccatacccatctatctacctttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggggggggcagcctcctgtcttcctaagcctggtggggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tatttctggcttcccaaattgtctgtaagcttctctgctttccacacttatgaccaatg
1501 taatattgctgttccacagcccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggccctagagaagaaagattgtacac
1741 taaggcaaattcaaaaacaaaccaaagtgcccactacagcagttgaaatctgacattttt
1801 taatcaatttaaatgagccattcatagtttcatattataaatactcatcagttttctg
1861 tacaataaaattattttaattcgatcaatacacaaatgaatgtagcttttttttgtttaa
1921 gctctcatctcgttctgtacttttaattcatcacgtcaactttgcagaatatcacctcca
1981 cttccatcattttcctgctcactggtgttcctgggctggaagccttccacacctggatct
2041 ccattcccttctgcttcctctctgtaactgctctcttgggaaacagcctgatcctcttcg
```

```
   1                                         M  Y  Y  F  L  S  M  L  S  A
2101 ctaccatcactcagcccagcctccacgaacca ATG TAC TAT TTC CTC TCC ATG CTG TCC G
```

Figure 2F-2

```
  11       T  D  L  G  L  S  I  S  T  L  V  T  M  L  S  I  F  W  N
2161 CCACTGACCTCGGCCTGTCCATATCCACTCTGGTCACCATGCTGAGTATATTCTGGTTCA
  31       V  R  E  I  S  F  N  A  C  L  S  H  M  F  F  I  K  F  F  T
2221 ATGTGAGGGAAATCAGCTTTAATGCCTGCTTGTCCCACATGTTCTTTATTAAATTCTTCA
  51       V  M  E  S  S  V  L  L  A  M  A  F  D  R  F  V  A  V  S  N
2281 CTGTCATGGAATCCTCAGTGCTGTTGGCCATGGCTTTTGATCGTTTTGTGGCCGTCTCTA
  71       P  L  R  Y  A  M  I  L  T  D  S  R  I  A  Q  I  G  V  A  S
2341 ATCCCCTTAGGTATGCCATGATTTTAACTGACTCCAGAATAGCTCAAATTGGAGTGGCAA
  91       V  I  R  G  L  L  M  L  T  P  M  V  A  L  L  I  R  L  S  Y
2401 GTGTCATCAGGGGGCTCCTAATGCTGACACCAATGGTAGCACTTCTTATAAGACTTTCCT
 111       C  H  S  Q  V  L  H  H  S  Y  C  Y  H  P  D  V  M  K  L  S
2461 ACTGCCACAGCCAAGTACTCCACCACTCCTACTGCTACCACCCTGATGTGATGAAGCTCT
 131       C  T  D  T  R  I  N  S  A  V  G  L  T  A  M  F  S  T  V  G
2521 CATGCACAGACACCAGAATCAACAGTGCAGTTGGGCTGACTGCCATGTTCTCTACTGTTG
 151       V  D  L  L  I  L  L  S  Y  V  L  I  I  R  T  V  L  S  V
2581 GTGTAGACTTACTTCTCATCCTCCTTTCTTATGTTTTGATCATTAGGACTGTCCTTAGCG
 171       A  S  P  E  E  R  K  E  T  F  S  T  C  V  S  H  I  V  A  F
2641 TTGCTTCCCCAGAAGAGAGGAAGGAAACCTTCAGTACATGTGTCTCCCACATTGTGGCTT
 191       A  I  Y  Y  I  P  L  I  S  L  S  I  V  H  R  F  G  K  Q  A
2701 TTGCTATATATTACATTCCATTGATCAGTCTGTCCATTGTTCACAGATTTGGGAAACAAG
 211       P  A  Y  V  H  T  M  I  A  N  T  Y  L  L  I  S  P  L  M  N
2761 CCCCAGCCTATGTACATACTATGATTGCTAACACCTACCTGCTGATCTCCCCTTTGATGA
 231       P  V  I  Y  S  V  K  T  K  Q  I  R  R  A  V  I  K  I  L  H
2821 ACCCTGTCATCTACAGTGTGAAAACCAAACAGATACGTAGAGCTGTGATAAAAATTCTCC
 251       S  K  E  T  *
2881 ATTCCAAAGAAACATAAaattgtagaattctagcactagatggacccctcaagatggtat
2941 acttcaggtcatgtttccaattaaaaacaaaaaacaaccaaagaactggtgcccattgaa
3001 gctaagcacataatcatttaaagttaaagctggaatgtatctagaacatcagctagtttg
3061 actactttattttccagatgaggaggtgaagacatgggatggaagagatgaacagcctaa
3121 aattagcctatatataaaatttctccttctcacaccactgttgggtccaaactgttgtt
3181 gccttctgtccctgccaacacccttctgttattatctcatctacttcatagcctttaga
3241 atgacacattacagaaaagtcactcctttgtgagaaataggtagtattttccaactgttc
3301 tagtaatttcgattgccatttattatttgctctgacaagtcatggttctaagtgtttttt
3361 gtatgtattaacatatttatatctaaaacaatgttataagataatcactttaattatca
3421 ataagaaaattgaggcatgaaatgttaagtagcttgcttaaacagctagtaactggtgtt
3481 gctgatggcagagcacatccatgcagactgactccagagtcccccacactcttaatttta
3541 atgttatattgctacctataatataatatataggtatataatttatatataatttatatt
3601 tgtaaaaattatatgaacttatatatataaacttatattttataaattatgtacttatatg
3661 tgtaaattatatttatatttataaatataaatatagagagaagttcaggcaattttttact
3721 aggaaacataaagaagtaaaaaaaaaaaaaaaaa
```

Figure 2G. The cDNA (SEQ ID:8882) and amino acid sequence (SEQ ID:8883) of 238P1B2 v.6. The start methionine is underlined. The open reading frame extends from nucleic acid 2133-2897 including the stop codon.

```
   1 ccgccttccaggttcactccattctcctgcctcagcctccccagtagctggaactacagg
  61 cgcccgccaccacgcccggctaattttttgtattttagtggagacgaggtttcaccatg
 121 ttggccaggatggtctcgatctcctgacctcgtgatccgccacctcggcctcccaaagt
 181 gctgggactacaggcgtgagccaccgcgcccagcctgctcaacacttttacacatgccgt
 241 tctgaaagcctgggaattcttcgtctcaacttacataaaacacagaaatctttcaagcac
 301 tgcttttctagaaagccttctccaaatactacaaacctactgaatgtctctttctggt
 361 aattccttttagtgtgttttggttttcaaaatcatttatcttatttctagttgacaa
 421 ataatatggtatatatttgtggggtaaaatgtgatgttgttatacatgtatgcattgtgg
 481 aatgaccaaatcaagctaattatcatatccatcacctcaaatatttatcatttctttgtg
 541 ctgtgaacatttaaaattctctcttttagttttttgaaatatactatacattaactata
 601 attcttatttctctaagagggtttgatcatacattttagatattttcatcactcgcctgag
 661 gacactgtcattactgtaaatttcagaatctaaagctatagtttcattatttggccaaat
 721 cgtgtaatctataatttcttgtttttcatctagttttctgttaattttagttaaatcaca
 781 ccccaccccccttttttttcactaagacttcttccggtgatccttgaggtgacactt
 841 tatcagggtgaatgtgtgagtctggatacgttgaggttcctctccatcctctcttttgtc
 901 aacacttactgtcagccacccagcaccctttcttttcctctgaagaagttaccctgcaac
 961 tggctctctcattgattgagccctctgcagccacaaccctaatctctgtttttcccta
1021 gaccccgtcttcaactcaaccatacccatctatctacctttctgcaattctccactcta
1081 tgaaaaagaaatgtgatgtttgcaataaagttatattttccctccgaaacaaaacagt
1141 aacattcaattaggtatctcctaagaagtatgtcttaacaaaatagagagattctgttct
1201 ggagaactagtcttccagcagactgaagagagaactgtgttggaacgtggcagcacatta
1261 tatcaggtgggggcagcctcctgtcttcctaagcctggtgggaggtctgtgttctaacca
1321 tctcttccaaatatgatgccgggtatcatattgtaagggtttctttaatggttagatgct
1381 gaagccatttatttgtcacttcctatgtgttactttgtattataatgatctctttcttca
1441 tattttctggcttcccaaattgtctgtaagcttctctgctttccacacttatgaccaatg
1501 taatattgctgttccacagccccagtgtattttctctggtgccaaccatagaggaaaaa
1561 taatgcactacctctttagcacaatttaaacatgccataaagaatgaaatatgattggca
1621 aactcagggtaaagtgtttattcttagtttggttatctatggctagaacgatcagaggag
1681 tggtcacatgatataaacatagctgccagcaaagggcctagagaagaaagattgtacac
1741 taaggcaaattcaaaaacaaaccaaagtgcccactacagcagttgaaatctgacatttt
1801 taatcaatttaaatgagccattcatagtttcatattatataaatactcatcagttttctg
1861 tacaataaaattatttaattcgatcaatacacaaatgaatgtagctttttttgtttaa
1921 gctctcatctcgttctgtacttttaattcatcacgtcaactttgcagaatatcacctcca
1981 cttccatcattttcctgctcactggtgttcctgggctggaagccttccacacctggatct
2041 ccattcccttctgcttcctctctgtaactgctctcttgggaaacagcctgatcctcttcg
                                       M  Y  Y  F  L  S  M  L  S  A
2101 ctaccatcactcagcccagcctccacgaaccaATGTACTATTTCCTCTCCATGCTGTCCG
```

Figure 2G-2

```
    11      T  D  L  G  L  S  I  S  T  L  V  T  M  L  S  I  F  W  F  N
  2161 CCACTGACCTCGGCCTGTCCATATCCACTCTGGTCACCATGCTGAGTATATTCTGGTTCA
    31      V  R  E  I  S  F  N  A  C  L  S  H  M  F  F  I  K  F  F  T
  2221 ATGTGAGGGAAATCAGCTTTAATGCCTGCTTGTCCCACATGTTCTTTATTAAATTCTTCA
    51      V  M  E  S  S  V  L  L  A  M  A  F  D  R  F  V  A  V  S  N
  2281 CTGTCATGGAATCCTCAGTGCTGTTGGCCATGGCTTTTGATCGTTTTGTGGCCGTCTCTA
    71      P  L  R  Y  A  M  I  L  T  D  S  R  I  A  Q  I  G  V  A  S
  2341 ATCCCCTTAGGTATGCCATGATTTTAACTGACTCCAGAATAGCTCAAATTGGAGTGGCAA
    91      V  I  R  G  L  L  M  L  T  P  M  V  A  L  L  I  R  L  S  Y
  2401 GTGTCATCAGGGGGCTCCTAATGCTGACACCAATGGTAGCACTTCTTATAAGACTTTCCT
   111      C  H  S  Q  V  L  H  H  S  Y  C  Y  H  P  D  V  M  K  L  S
  2461 ACTGCCACAGCCAAGTACTCCACCACTCCTACTGCTACCACCCTGATGTGATGAAGCTCT
   131      C  T  D  T  R  I  N  S  A  V  G  L  T  A  M  F  S  T  V  G
  2521 CATGCACAGACACCAGAATCAACAGTGCAGTTGGGCTGACTGCCATGTTCTCTACTGTTG
   151      V  D  L  L  L  I  L  L  S  Y  V  L  I  I  R  T  V  L  S  V
  2581 GTGTAGACTTACTTCTCATCCTCCTTTCTTATGTTTTGATCATTAGGACTGTCCTTAGCG
   171      A  S  P  E  E  R  K  E  T  F  S  T  C  V  S  H  I  V  A  F
  2641 TTGCTTCCCCAGAAGAGAGGAAGGAAACCTTCAGTACATGTGTCTCCCACATTGTGGCTT
   191      A  I  Y  Y  I  P  L  I  S  L  S  I  V  H  R  F  G  K  Q  A
  2701 TTGCTATATATTACATTCCATTGATCAGTCTGTCCATTGTTCACAGATTTGGGAAACAAG
   211      P  A  Y  V  H  T  M  I  A  N  T  Y  L  L  I  S  P  L  M  N
  2761 CCCCAGCCTATGTACATACTATGATTGCTAACACCTACCTGCTGATCTCCCCTTTGATGA
   231      P  V  I  Y  S  V  K  T  K  Q  I  R  R  A  V  I  K  I  L  H
  2821 ACCCTGTCATCTACAGTGTGAAAACCAAACAGATACGTAGAGCTGTGATAAAAATTCTCC
   251      S  K  E  T  *
  2881 ATTCCAAAGAAACATAAaattgtagaattctagcactagatggacccctcaagatggtat
  2941 acttcaggtcatgtttccaattaaaaacaaaaaacaaccaaagaactggtgcccattgaa
  3001 gctaagcacataatcatttaaagttaaagctggaatgtatctagaacatcagctagtttg
  3061 actactttattttccagatgaggaggtgaagacatgggatggaagagatgaacagcctaa
  3121 aattagccttatatataaaatttctccttctcacaccactgttgggtccaaactgttgtt
  3181 gccttctgtccctgccaacaccctttctgttattatctcatctacttcatagcctttaga
  3241 atgacacattacagaaaagtcactcctttgtgagaaataggtagtattttccaactgttc
  3301 tagtaatttcgattgccatttattatttgctctgacaagtcatggttctaagtgttttt
  3361 gtatgtattaacatatttatatctaaaacaatgttataagataatcactttaattatca
  3421 ataagaaaattgaggcatgaaatgttaagtagcttgcttaaacagctagtaactggtgtt
  3481 gctgatggcagagcacatccatgcagactgactccagagtcccccacactcttaatttta
  3541 atgttatattgctacctataatataatatataggtatataatttatatataatttatatt
  3601 tgtaaaaattatatgaacttatatatataaacttatatttataaattatgtacttatatg
  3661 tgtaaattatatttatatttataaatataaatatagagagaagttcaggcaattttttact
  3721 aggaaacataaagaagtaaaaaaaaaaaaaaaaa
```

Figure 3A. Amino acid sequence of 238P1B2 v.1A clone A (SEQ ID. NO.:8884). The 238P1B2 v.1 protein has 254 amino acids.

```
1    MYYFLSMLSA TDLGLSISTL VTMLSIFWFN VREISFNACL SHMFFIKFFT VMESSVLLAM
61   AFDRFVAVSN PLRYAMILTD SRIAQIGVAS VIRGLLMLTP MVALLIRLSY CHSQVLHHSY
121  CYHPDVMKLS CTDTRINSAV GLTAMFSTVG VDLLLILLSY VLIIRTVLSV ASPEERKETF
181  STCVSHIVAF AIYYIPLISL SIVHRFGPQA PAYVHTMIAN TYLLISPLMN PVIYSVKTKQ
241  IRRAVIKILH SKET
```

Figure 3B. Amino acid sequence of 238P1B2 v.1B (SEQ ID. NO.:8885). The 238P1B2 v.1B protein has 316 amino acids.

```
1    FITSTLQNIT STSIIFLLTG VPGLEAFHTW ISIPFCFLSV TALLGNSLIL FATITQPSLH
61   EPMYYFLSML SATDLGLSIS TLVTMLSIFW FNVREISFNA CLSHMFFIKF FTVMESSVLL
121  AMAFDRFVAV SNPLRYAMIL TDSRIAQIGV ASVIRGLLML TPMVALLIRL SYCHSQVLHH
181  SYCYHPDVMK LSCTDTRINS AVGLTAMFST VGVDLLLILL SYVLIIRTVL SVASPEERKE
241  TFSTCVSHIV AFAIYYIPLI SLSIVHRFGK QAPAYVHTMI ANTYLLISPL MNPVIYSVKT
301  KQIRRAVIKI LHSKET
```

Figure 3C. Amino acid sequence of 238P1B2 v.2 (SEQ ID. NO.:8886). The 238P1B2 v.2 protein has 254 amino acids.

```
1    MYYFLSMLSA TDLGLSISTL VTMLSIFWFN VREISFNACL SHMFFIKFFT VMESSVLLAM
61   AFDRFVAVSN PLRYAMILTD SRIAQIGVAS VIRGLLMLTP MVALLIRLSY CHSQVLHHSY
121  CYHPDVMKLS CTDTRINSAV GLTAMFSTVG VDLLLILLSY VLIIRTVLSV ASPEERKETF
181  STCVSHIVAF AIYYIPLISL SIVHRFGPQA PAYVHTMIAN TYLLTSPLMN PVIYSVKTKQ
241  IRRAVIKILH SKET
```

Figure 4A. Nucleic Acid sequence alignment of 238P1B2 v.1 (SEQ ID:8887) with mouse olfactory receptor MOR14-1 (SEQ ID:8888).

```
>gi|18479243|gb|AY072973.1| Mus musculus olfactory receptor MOR14-1 gene,
complete cds          Length = 945

Score =  793 bits (400), Expect = 0.0
 Identities = 784/912 (85%)
 Strand = Plus / Plus Query: 1981  cttccatcattttcctgctcactggtgttcctgggctggaagccttccacacctggatct 2040
             |||||||||||||||||||||||||||| || ||||||||||| ||||||||||||||||
Sbjct: 29    cttccatcattttcctgctcactggtgtgcccgggctggaagctttccacacctggatct 88

Query: 2041  ccattcccttctgcttcctctctgtaactgctctcttgggaaacagcctgatcctcttcg 2100
             |||||||||||||||| |||| |||||| || |  || |||||||||||||| ||||| |
Sbjct: 89    ccattcccttctgctttctctatgcaactgccctgtcagggaacagcctgattctctttg 148

Query: 2101  ctaccatcactcagcccagcctccacgaaccaatgtactatttcctctccatgctgtccg 2160
              |   |||||  |||||||||||||||| |||||  ||  |||||||||||||||  | 
Sbjct: 149   tcattatcacccagcccagcctccacgagcccatgtattacttcctctccatgctatcca 208

Query: 2161  ccactgacctcggcctgtccatatccactctggtcaccatgctgagtatattctggttca 2220
             ||||||||||||| || |||| ||||||||| ||||||||||| | | ||||||||||||
Sbjct: 209   ccactgacctcgggctctccatctccactctggccaccatgctggggatattctggttca 268

Query: 2221  atgtgagggaaatcagcttaatgcctgcttgtcccacatgttctttattaaattcttca 2280
             | |  ||||| ||||||| |||||||||||||| | ||||||| |||||| ||||||
Sbjct: 269   acgccagggagatcagcttcaatgcctgcttgtcactgatgttcttcattaaactcttca 328

Query: 2281  ctgtcatggaatcctcagtgctgttggccatggcttttgatcgttttgtggccgtctcta 2340
             |||||||||||||||||||||||||||| ||||||| |||||||| ||||||| | | |
Sbjct: 329   ctgtcatggaatcctcagtgctgttggctatggcttatgatcgttatgtggccatctcca 388

Query: 2341  atccccttaggtatgccatgatttttaactgactccagaatagctcaaattggagtggcaa 2400
             | || |||||||||||| | |||||||||||| ||||||||||||||||||| || ||
Sbjct: 389   accctcttaggtatgccactattttaactgattccagaatagctcaaattggggtgacaa 448

Query: 2401  gtgtcatcaggggctcctaatgctgacaccaatggtagcacttcttataagactttcct 2460
             |||||||| |||    ||||| |||||| || ||||||| ||||||||||   |||  |
Sbjct: 449   ttgtcatcagagggactgtaatgttgacaccgatggtcgcacttcttaagagactaacct 508

Query: 2461  actgccacagccaagtactccaccactcctactgctaccaccctgatgtgatgaagctct 2520
             | ||  ||||  || ||||||||||||||||| |  |||||| ||||| ||||||||||
Sbjct: 509   tctgcagcagccgtgtgctccaccactcctactgtttccaccccgatgtcatgaagctct 568

Query: 2521  catgcacagacaccagaatcaacagtgcagttgggctgactgccatgttctctactgttg 2580
             |||||||||||||||||| ||||| ||||||||| |||||||||||||| |||||||||
Sbjct: 569   catgcacagacaccaggatcaacaatgcagttggattgactgccatgatctctactgttg 628

Query: 2581  gtgtagacttacttctcatcctcctttcttatgttttgatcattaggactgtccttagcg 2640
             |||| |||| | |  || || |||||||| || |  ||| || || ||||||| |||
Sbjct: 629   gtgtggactcagtccttattctcctttcctacatcctgatcatcagaactgtcctcagca 688
```

Figure 4A-2

```
Query: 2641 ttgcttccccagaagagaggaaggaaaccttcagtacatgtgtctcccacattgtggctt 2700
             ||||||||||||||||||||||||| || ||||||| || ||| ||||||| || | ||||
Sbjct: 689  ttgcttccccagaagagaggaagaaagccttcagcacgtgtatctcccatatcggggctg 748

Query: 2701 ttgctatatattacattccattgatcagtctgtccattgttcacagatttgggaaacaag 2760
             | |||||||   || ||||||||||||||| ||||| |||||||||||||||||||| ||
Sbjct: 749  tagctatattctatattccattgatcagtttgtcctttgttcacagatttgggaacgag 808

Query: 2761 ccccagcctatgtacatactatgattgctaacacctacctgctgatctccccttttgatga 2820
             | ||| |||||||||||| ||||||||||||| |||||||||||||   | ||| | ||||
Sbjct: 809  ctccacccctatgtacataccatgattgctaatacctacctgctgattcctcctgtcatga 868

Query: 2821 accctgtcatctacagtgtgaaaaccaaacagatacgtagagctgtgataaaaattctcc 2880
             ||||    ||||||||||||||| |||||||||||||| |||||||||||||||| || |||
Sbjct: 869  accccatcatctacagtgtgaagaccaaacagatacgtaaagctgtgataaaagttttcc 928

Query: 2881 attccaaagaaa 2892
             | || ||||||||
Sbjct: 929  aatctaaagaaa 940
```

Figure 4B. Nucleic Acid sequence alignment of 238P1B2 v.1 (SEQ ID:8889) with mouse olfactory receptor MOR14-10 (SEQ ID:8890).

```
>gi|18480765|gb|AY073734.1| Mus musculus olfactory receptor MOR14-10 gene,
complete cds        Length = 993

Score =  607 bits (306), Expect = e-170
 Identities = 756/906 (83%)
 Strand = Plus / Plus Query: 1981  cttccatcatttcctgctcactggtgttcctgggctggaagccttccacacctggatct 2040
             |||||||||||||||||||||||||||| |||||||||||||||||||||||||||||||
Sbjct: 29    cttccatcatttcctgctcactggtgtgcctgggctggaagccttccacacctggatct 88

Query: 2041  ccattcccttctgcttcctctctgtaactgctctcttgggaaacagcctgatcctcttcg 2100
             ||||||||||||||| ||||  |||||| ||  |  || |||||||||||| ||||| |
Sbjct: 89    ccattcccttctgctttctctatgcaactgccctgtcagggaacagcctgattctctttg 148

Query: 2101  ctaccatcactcagcccagcctccacgaaccaatgtactatttcctctccatgctgtccg 2160
             |  ||||| |||||||||||||||| || || ||||  |||||||||||| ||||||| 
Sbjct: 149   tcattatcacccagcccagcctccatgagcccatgtgttatttcctctctatgctgtcca 208

Query: 2161  ccactgacctcggcctgtccatatccactctggtcaccatgctgagtatattctggttca 2220
             |||||||||||||| || |||| ||||||||||||||||||| |  |||||||||||||
Sbjct: 209   ccactgacctcgggctctccatctccactctggccaccatgctggggatattctggttca 268

Query: 2221  atgtgagggaaatcagctttaatgcctgcttgtcccacatgttctttattaaattcttca 2280
             |    | || ||||||||| |||||  || ||||| || ||||||||| || |||||||
Sbjct: 269   acgccagagagatcagcttcaatgcttgcttgtcacaaatgttctttattcaactcttca 328

Query: 2281  ctgtcatggaatcctcagtgctgttggccatggcttttgatcgttttgtggccgtctcta 2340
             |||||||||||||||||||||||||||| |||||||||||||| ||||||||||||| |
Sbjct: 329   ctgtcatggaatcctcagtgctgttggctatggcttttgatcgttatgtggccatctcca 388

Query: 2341  atcccttaggtatgccatgattttaactgactccagaatagctcaaattggagtggcaa 2400
             | || ||||||||||   |  ||||||||   |  | ||||||||| ||||||| ||||
Sbjct: 389   accctcttaggtatgcttcggtcttaactgaccttaaaatagctcagattggagtagcaa 448

Query: 2401  gtgtcatcaggggggctcctaatgctgacaccaatggtagcacttcttataagactttcct 2460
             ||| | |||||| || || || ||| ||||| || |||  || ||||| ||   || ||
Sbjct: 449   ttgttaccaggggcacactgatactgactcctatggttgtccttcttaaaagattatcct 508

Query: 2461  actgccacagccaagtactccaccactcctactgctaccaccctgatgtgatgaagctct 2520
             ||||   |||||| || || || ||||||||| |  |||||||||||| |||||||||
Sbjct: 509   actgtagcagccatgtgcttcatcactcctactgttccacccctgatgtcatgaagctct 568

Query: 2521  catgcacagacaccagaatcaacagtgcagttgggctgactgccatgttctctactgttg 2580
             ||||||||||||||| ||||||||||||||||||| ||||| ||||||||||||| ||
Sbjct: 569   catgcacagacaccaggatcaacagtgcagttgggctcactgccctgatctccactgctg 628

Query: 2581  gtgtagacttacttctcatcctcctttcttatgttttgatcattaggactgtccttagcg 2640
             | || |||   |  ||||| |||| ||||| ||||||| ||||||| ||||||||  ||
Sbjct: 629   gagttgactctgtcttcatcatcctctcctatgtcctgatcatcagaactgtcctcagca 688
```

Figure 4B-2

```
Query: 2641  ttgcttccccagaagagaggaaggaaaccttcagtacatgtgtctcccacattgtggctt  2700
             ||||||||||||||||||||||||| || |||||||| || ||| ||||||| |||| ||||
Sbjct: 689   ttgcttccccagaagagaggaagaaagccttcagcacgtgtatctcccatattggggctg  748

Query: 2701  ttgctatatattacattccattgatcagtctgtccattgttcacagatttgggaaacaag  2760
             | ||| | |  || |||||| |||| |||||||||| |||| ||||||||||||||| ||
Sbjct: 749   tggctgtgttctatattccactgattagtctgtcctttgtccacagatttgggaaacgag  808

Query: 2761  ccccagcctatgtacatactatgattgctaacacctacctgctgatctcccctttgatga  2820
             | || | |||||| |||||| ||||||| ||  |||||||||||||| | ||| | ||||
Sbjct: 809   ctccgccatatgtccatactctgattgccaatgcctacctgctgatccctcctgtcatga  868

Query: 2821  accctgtcatctacagtgtgaaaaccaaacagatacgtagagctgtgataaaaattctcc  2880
             ||||   |||||||||||||||| |||||  |||||| ||||||| | ||||| | |||| || |||
Sbjct: 869   acccatcatctacagtgtgaagaccaagaagatacggaaggctgtgttgaaagttttcc  928

Query: 2881  attcca  2886
             ||||||
Sbjct: 929   attcca  934
```

Figure 4C. Amino Acid sequence alignment of 238P1B2 v.1A (SEQ ID:8891) with mouse olfactory receptor MOR14-1 (SEQ ID:8892).

```
>gi|18479244|gb|AAL60636.1| (AY072973) olfactory receptor MOR14-1 [Mus musculus]
          Length = 314

Score =  342 bits (878), Expect = 2e-93
 Identities = 210/253 (83%), Positives = 230/253 (90%)

238P1B2: 1     MYYFLSMLSATDLGLSISTLVTMLSIFWFNVREISFNACLSHMFFIKFFTVMESSVLLAM 60
               MYYFLSMLS TDLGLSISTL TML IFWFN REISFNACLS MFFIK FTVMESSVLLAM
MOR14-1: 61    MYYFLSMLSTTDLGLSISTLATMLGIFWFNAREISFNACLSLMFFIKLFTVMESSVLLAM 120

238P1B2: 61    AFDRFVAVSNPLRYAMILTDSRIAQIGVASVIRGLLMLTPMVALLIRLSYCHSQVLHHSY 120
               A+DR+VA+SNPLRYA ILTDSRIAQIGV  VIRG +MLTPMVALL RL++C S+VLHHSY
MOR14-1: 121   AYDRYVAISNPLRYATILTDSRIAQIGVTIVIRGTVMLTPMVALLKRLTFCSSRVLHHSY 180

238P1B2: 121   CYHPDVMKLSCTDTRINSAVGLTAMFSTVGVDLLLILLSYVLIIRTVLSVASPEERKETF 180
               C+HPDVMKLSCTDTRIN+AVGLTAM STVGVD +LILLSY+LIIRTVLS+ASPEERK+ F
MOR14-1: 181   CFHPDVMKLSCTDTRINNAVGLTAMISTVGVDSVLILLSYILIIRTVLSIASPEERKKAF 240

238P1B2: 181   STCVSHIVAFAIYYIPLISLSIVHRFGPQAPAYVHTMIANTYLLISPLMNPVIYSVKTKQ 240
               STC+SHI A AI+YIPLISLS VHRFG +AP YVHTMIANTYLLI P+MNP+IYSVKTKQ
MOR14-1: 241   STCISHIGAVAIFYIPLISLSFVHRFGKRAPPYVHTMIANTYLLIPPVMNPIIYSVKTKQ 300

238P1B2: 241   IRRAVIKILHSKE 253
               IR+AVIK+  SKE
MOR14-1: 301   IRKAVIKVFQSKE 313
```

Figure 4D. Amino Acid sequence alignment of 238P1B2 v.1A (SEQ ID:8893) with prostate specific GPCR PHOR-1 (SEQ ID:8894).

```
Score =  254 bits (650), Expect = 4e-67
Identities = 120/250 (48%), Positives = 177/250 (70%), Gaps = 1/250 (0%)

238P1B2: 1     MYYFLSMLSATDLGLSISTLVTMLSIFWFNVREISFNACLSHMFFIKFFTVMESSVLLAM 60
               MY FL MLS D+ +S S++ ML+IFWFN   I F+ACL  +F I   + MES+VLLAM
PHOR-1:  62    MYIFLCMLSGIDILISTSSMPKMLAIFWFNSTTIQFDACLLQIFAIHSLSGMESTVLLAM 121

238P1B2: 61    AFDRFVAVSNPLRYAMILTDSRIAQIGVASVIRGLLMLTPMVALLIRLSYCHSQVLHHSY 120
               AFDR+VA+ +PLR+A +LT  R+ +IGVA+V+RG  ++ P+    +L +C S +L HSY
PHOR-1:  122   AFDRYVAICHPLRHATVLTLPRVTKIGVAAVVRGAALMAPLPVFIKQLPFCRSNILSHSY 181

238P1B2: 121   CYHPDVMKLSCTDTRINSAVGLTAMFSTVGVDLLLILLSYVLIIRTVLSVASPEERKETF 180
               C H DVMKL+C D R+N   GL  + S +G+D LLI  SY+LI++TVL + + E + + F
PHOR-1:  182   CLHQDVMKLACDDIRVNVVYGLIVIISAIGLDSLLISFSYLLILKTVLGL-TREAQAKAF 240

238P1B2: 181   STCVSHIVAFAIYYIPLISLSIVHRFGPQAPAYVHTMIANTYLLISPLMNPVIYSVKTKQ 240
                TCVSH+  A  I+Y+P I LS+VHRF   +  +   ++AN YLL+ P++NP++Y VKTK+
PHOR-1:  241   GTCVSHVCAVFIFYVPFIGLSMVHRFSKRRDSPLPVILANIYLLVPPVLNPIVYGVKTKE 300

238P1B2: 241   IRRAVIKILH 250
               IR+ ++++ H
PHOR-1:  301   IRQRILRLFH 310
```

Figure 4E. Alignment of 238P1B2 variant 1 (SEQ ID:8895) with human olfactory receptor 51I2 (SEQ ID:8896).

```
Identities = 154/252 (61%), Positives = 201/252 (79%)

Query:  1     MYYFLSMLSATDLGLSISTLVTMLSIFWFNVREISFNACLSHMFFIKFFTVMESSVLLAM 60
              MYYFLSMLSATDL LS+ TL T L +FWF  REI+ NAC++ MFF+  FT MES VLLAM
Sbjct:  73    MYYFLSMLSATDLSLSLCTLSTTLGVFWFEAREINLNACIAQMFFLHGFTFMESGVLLAM 132

Query:  61    AFDRFVAVSNPLRYAMILTDSRIAQIGVASVIRGLLMLTPMVALLIRLSYCHSQVLHHSY 120
              AFDRFVA+  PLRY  ILT++RIA+IG++ +IR + ++ P++   + RLS+C S VL HSY
Sbjct:  133   AFDRFVAICYPLRYTTILTNARIAKIGMSMLIRNVAVMLPVMLFVKRLSFCSSMVLSHSY 192

Query:  121   CYHPDVMKLSCTDTRINSAVGLTAMFSTVGVDLLLILLSYVLIIRTVLSVASPEERKETF 180
              CYH D+++LSCTD RINS +GL A+ ST G D   ILLSY+LIIR+VLS+AS EER++ F
Sbjct:  193   CYHVDLIQLSCTDNRINSILGLFALLSTTGFDCPCILLSYILIIRSVLSIASSEERRKAF 252

Query:  181   STCVSHIVAFAIYYIPLISLSIVHRFGPQAPAYVHTMIANTYLLISPLMNPVIYSVKTKQ 240
              +TC SHI A +I+Y+PLISLS+VHR G  AP +VH ++AN +LLI P++NP+IYSVK KQ
Sbjct:  253   NTCTSHISAVSIFYLPLISLSLVHRYGHSAPPFVHIIMANVFLLIPPVLNPIIYSVKIKQ 312

Query:  241   IRRAVIKILHSK 252
              I++A+IK+L  K
Sbjct:  313   IQKAIIKVLIQK 324
```

Figure 4F. Clustal Alignment of the three 238P1B2 variants, depicting that 238P1B2 V1B contains an additional 62 aa at its N-terminus relative to V1A, and that 238P1B2 V2 carries a I to T point mutation at aa 225 relative to V1A. The variants are 238P1B2 v.1A (SEQ ID:8897); 238P1B2 v.1B (SEQ ID:8898); 238P1B2 v.2 (SEQ ID:8899).

```
v.1A     ----------------------------------------------------------------
v.1B     FITSTLQNITSTSIIFLLTGVPGLEAFHTWISIPFCFLSVTALLGNSLILFATITQPSLH
v.2      ---------------------------------------------------------------- v.1A     --MYYFLSMLSATDLGLSISTLVTMLSIFWFNVREISFNACLSHMFFIKFFTVMESSVLL
v.1B     EPMYYFLSMLSATDLGLSISTLVTMLSIFWFNVREISFNACLSIIMFTIKFFTVMESSVLL
v.2      --MYYFLSMLSATDLGLSISTLVTMLSIFWFNVREISFNACLSHMFFIKFFTVMESSVLL
            ************************************************************ v.1A     AMAFDRFVAVSNPLRYAMILTDSRIAQIGVASVIRGLLMLTPMVALLIRLSYCHSQVLHH
v.1B     AMAFDRFVAVSNPLRYAMILTDSRIAQIGVASVIRGLLMLTPMVALLIRLSYCHSQVLHH
v.2      AMAFDRFVAVSNPLRYAMILTDSRIAQIGVASVIRGLLMLTPMVALLIRLSYCHSQVLHH
         ************************************************************ v.1A     SYCYHPDVMKLSCTDTRINSAVGLTAMFSTVGVDLLLILLSYVLIIRTVLSVASPEERKE
v.1B     SYCYHPDVMKLSCTDTRINSAVGLTAMFSTVGVDLLLILLSYVLIIRTVLSVASPEERKE
v.2      SYCYHPDVMKLSCTDTRINSAVGLTAMFSTVGVDLLLILLSYVLIIRTVLSVASPEERKE
         ************************************************************ v.1A     TFSTCVSHIVAFAIYYIPLISLSIVHRFGPQAPAYVHTMIANTYLLISPLMNPVIYSVKT
v.1B     TFSTCVSHIVAFAIYYIPLISLSIVHRFGPQAPAYVHTMIANTYLLISPLMNPVIYSVKT
v.2      TFSTCVSHIVAFAIYYIPLISLSIVHRFGPQAPAYVHTMIANTYLLTSPLMNPVIYSVKT
         ********************************  **********  ********** v.1A     KQIRRAVIKILHSKET
v.1B     KQIRRAVIKILHSKET
v.2      KQIRRAVIKILHSKET
         ****************
```

238P1B2 variant 1a Hydrophilicity profile
(Hopp T.P., Woods K.R., 1981. Proc. Natl. Acad. Sci. U.S.A. 78:3824-3828)

238P1B2 variant 1b Hydrophilicity profile
(Hopp T.P., Woods K.R., 1981. Proc. Natl. Acad. Sci. U.S.A. 78:3824-3828)

238P1B2 variant 1a Hydropathicity Profile
(Kyte J., Doolittle R.F., 1982. J. Mol. Biol. 157:105-132)

238P1B2 variant 1b Hydropathicity Profile
(Kyte J., Doolittle R.F., 1982. J. Mol. Biol. 157:105-132)

238P1B2 variant 1a % Accessible Residues Profile
(Janin J., 1979. Nature 277:491-492)

238P1B2 variant 1b % Accessible Residues Profile
(Janin J., 1979. Nature 277:491-492)

238P1B2 variant 1a Average Flexibility Profile
(Bhaskaran R., Ponnuswamy P.K., 1988. Int. J. Pept. Protein Res. 32:242-255)

238P1B2 variant 1b Average Flexibility Profile
(Bhaskaran R., Ponnuswamy P.K., 1988.
Int. J. Pept. Protein Res. 32:242-255)

238P1B2 variant 1a Beta-turn Profile
(Deleage, G., Roux B. 1987. Protein Engineering 1:289-294)

238P1B2 variant 1b Beta-turn Profile
(Deleage, G., Roux B. 1987. Protein Engineering 1:289-294)

Figure 11

Figure 12A: Secondary structure prediction of 238P1B2 variant 1a

```
         10        20        30        40        50        60        70
          |         |         |         |         |         |         |
MYYFLSMLSATDLGLSISTLVTMLSIFWFNVREISFNACLSHMFFIKFFTVMESSVLLAMAFDRFVAVSN
chheehhhhhhhcccchhhhhhhhhhhhhhcchhhhhhhhcchhhhhhhhhhhhhhhhhhhhhhhhhhcc PLRYAMILTDSRIAQIGVASVIRGLLMLTPMVALLIRLSYCHSQVLHHSYCYHPDVMKLSCTDTRINSAV
cceeeeeecchhhhhhhhhhhhhhhhhhhhhhhhhhhhhhhcccceeccccccccccceccchhh GLTAMFSTVGVDLLLILLSYVLIIRTVLSVASPEERKETFSTCVSHIVAFAIYYIPLISLSIVHRFGKQA
chhhhhhhhhhhhhhhhhhhhhhhhhhhhhccccccccccchhhhhhhhhhhchehhehhcccccc PAYVHTMIANTYLLISPLMNPVIYSVKTKQIRRAVIKILHSKET
hhhhhhhhhhhhehhccccccheehhhhhhhhhecccccc
```

Alpha helix (h): 66.54%
Extended strand (e): 6.69%
Random coil (c) : 26.77%

Figure 12B: Secondary structure prediction of 238P1B2 variant 1b

```
         10        20        30        40        50        60        70
          |         |         |         |         |         |         |
FITSTLQNITSTSIIFLLTGVPGLEAFHTWISIPFCFLSVTALLGNSLIFATTQPSLHEPMYYFLSML
cchhhhccccceeeeccccchhhhhhhhhhhhccchhhhhhhhhhhhcccceeeeeeccccchhhhhhhhh SATDLGLSISTLVTMLSIFWFNVREISFNACLSHMFFIKFFTVMESSVLLAMAFDRFVAVSNPLRYAMIL
ccccccchhhhhhhhhhhhhhhhhcccchhhhhhhhhhhhhhhhhhhhhhhhhhhhhcccceeeee TDSRIAQIGVASVIRGLLMLTPMVALLIRLSYCHSQVLHHSYCYHPDVMKLSCTDTRINSAVGLTAMFST
cchhhhhhhhhhhhhhhhhhhhhhhhhhhhhhhhhcccceeccccccccccccccchhhchhhhhhhh VGVDLLLILLSYVLIIRTVLSVASPEERKETFSTCVSHIVAFAIYYIPLISLSIVHRFGKQAPAYVHTMI
hhhhhhhhhhhhhhhhhhhhhhhhhhhhccccccccccccccchhhhhchehehhcccccchhhhhhh ANTYLLISPLMNPVIYSVKTKQIRRAVIKILHSKET
hhhhehhccccchheehhhhhhhhhhheccccc
```

Alpha helix (h): 61.71%
Extended strand (e): 8.86%
Random coil (c): 29.43%

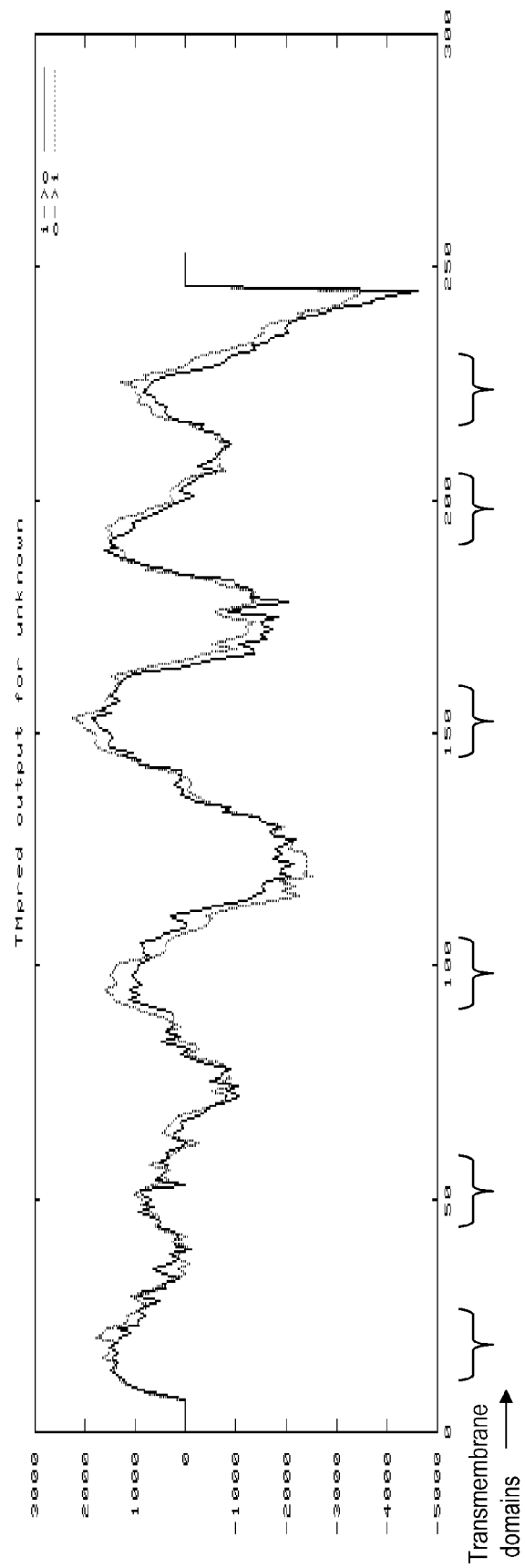
Figure 12C: Transmembrane prediction for 238P1B2 variant 1a

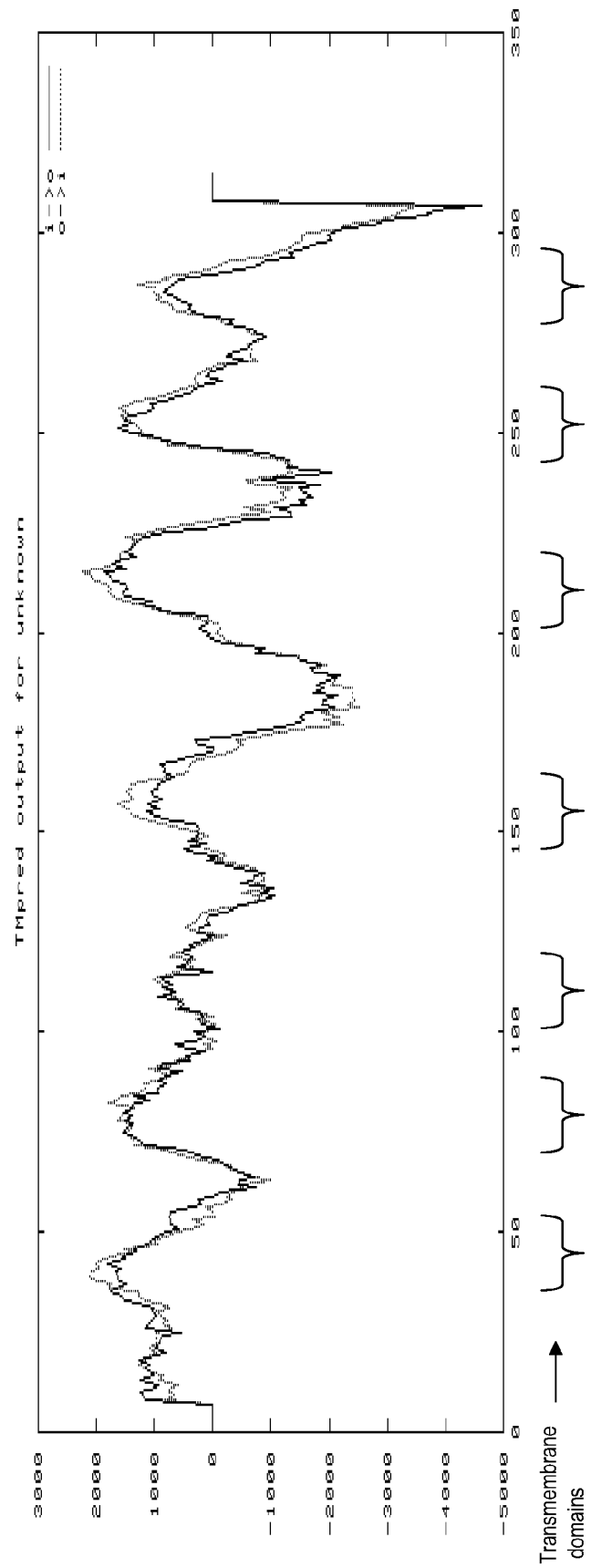
Figure 12E: Transmembrane prediction for 238P1B2 variant 1b

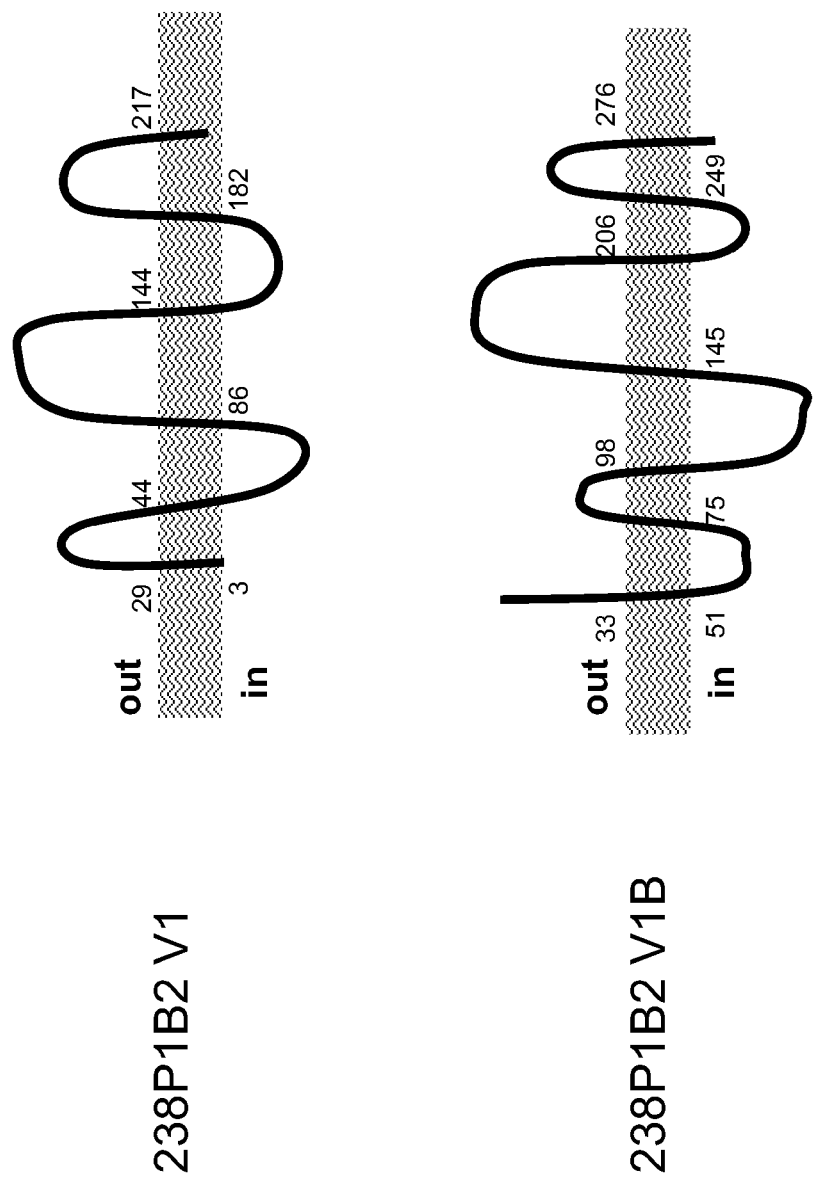
Figure 13: Probable Topology and Structure of 238P1B2 Variants
The numbers refer to amino acids at the beginning of each transmembrane domain.

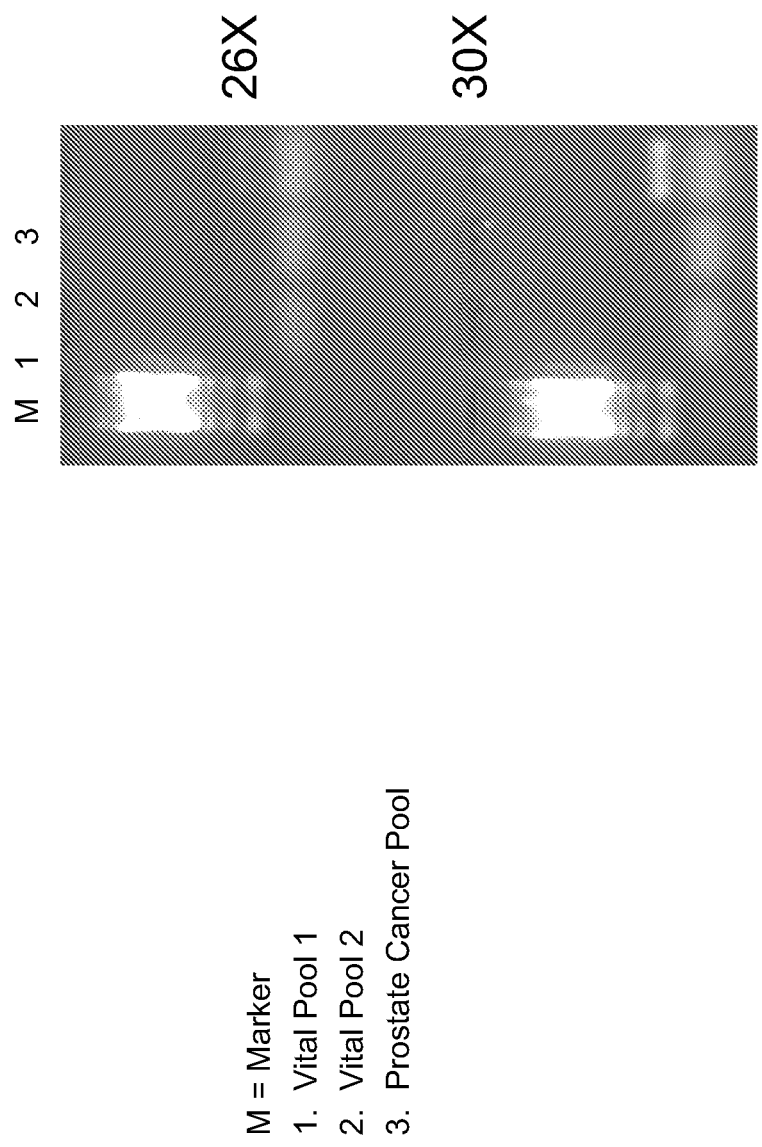
Figure 14: Expression of 238P1B2 by RT-PCR
M = Marker
1. Vital Pool 1
2. Vital Pool 2
3. Prostate Cancer Pool

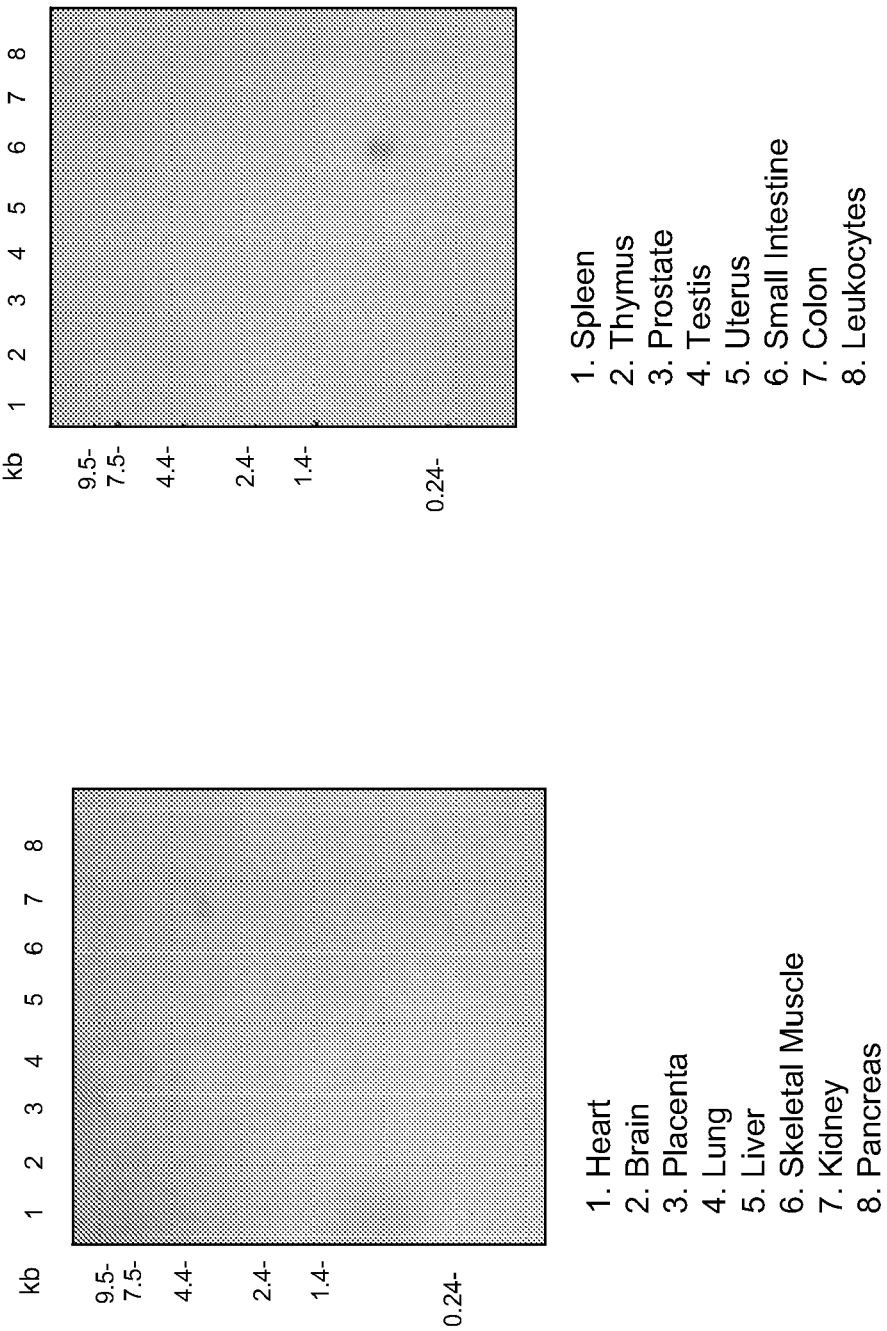
Figure 15: Expression of 238P1B2 in Normal Tissues

Figure 16: Expression of 238P1B2 in Multiple Normal Tissues

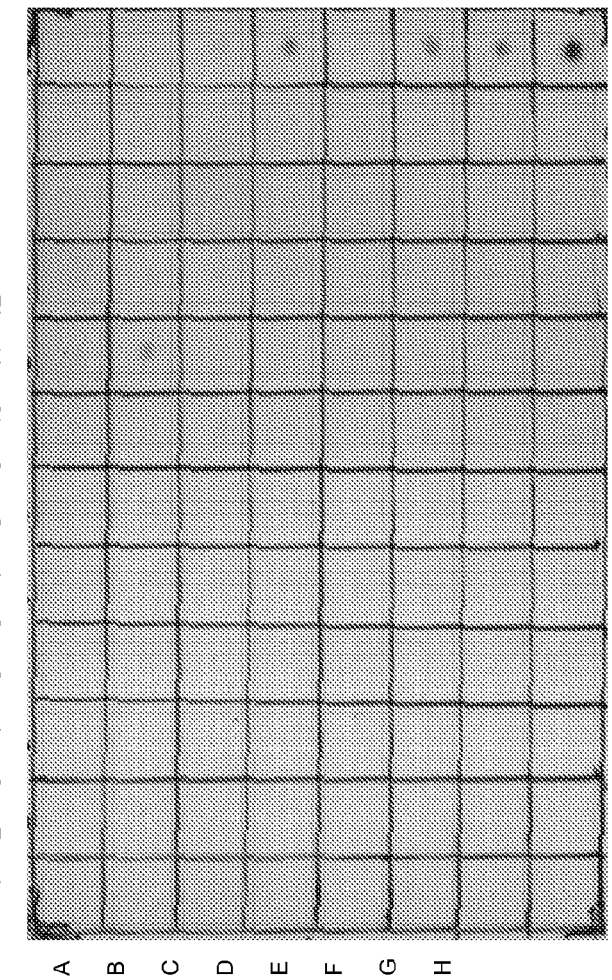

A1 whole brain
A2 cerebellum, left
A3 substantia nigra
A4 heart
A5 esophagus
A6 colon, transverse
A7 kidney
A8 lung
A9 liver
A10 HL60, leukemia
A11 fetal brain B1 cerebral cortex
B2 cerebellum, right
B3 accumbens nucleus
B4 aorta
B5 stomach
B6 colon, descending
B7 skeletal muscle
B8 placenta
B9 pancreas
B10 HeLa, S3
B11 fetal heart C1 frontal lobe
C2 corpus callosum
C3 thalamus
C4 atrium, left
C5 duodenum
C6 rectum
C7 spleen
C8 bladder
C9 adrenal gland
C10 K562, leukemia
C11 fetal kidney D1 parietal lobe
D2 amygdala
D3 pituitary gland
D4 atrium, right
D5 jejunum
D6 -
D7 thymus
D8 uterus
D9 thyroid gland
D10 MOLT-4
D11 fetal liver E1 occipital lobe
E2 caudate nucleus
E3 spinal cord
E4 ventricle, left
E5 ileum
E6 -
E7 leukocytes
E8 prostate
E9 salivary gland
E10 RAJI, lymphoma
E11 fetal spleen F1 temporal lobe
F2 hippocampus
F3 -
F4 ventricle, right
F5 ilocecum
F6 -
F7 lymph node
F8 testis
F9 mammary gland
F10 DAUDI, lymphoma
F11 fetal thymus
F12 Genomic DNA G1 paracentral gyrus
G2 medulla oblongata
G3 -
G4 interventricular septum
G5 appendix
G6 -
G7 bone marrow
G8 ovary
G9 -
G10 SW480, colon cancer
G11 fetal lung
G12 Genomic DNA H1 pons
H2 putamen
H3 -
H4 apex of the heart
H5 colon, ascending
H6 -
H7 trachea
H8 -
H9 -
H10 A549, lung cancer
H11 -
H12 Genomic DNA

Figure 17: Expression of 238P1B2 in Human Patient Cancer Specimens and in Normal Tissues
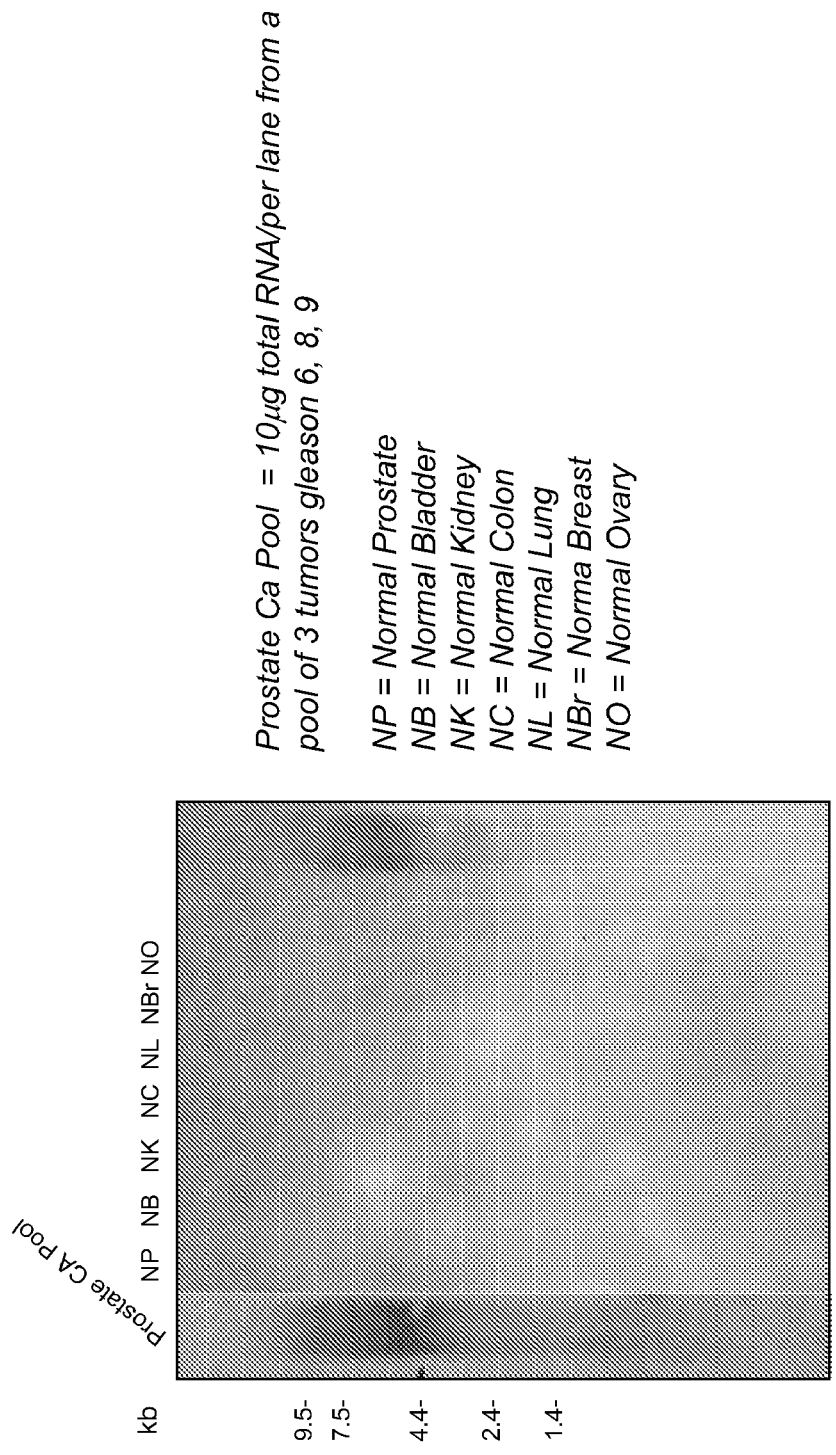

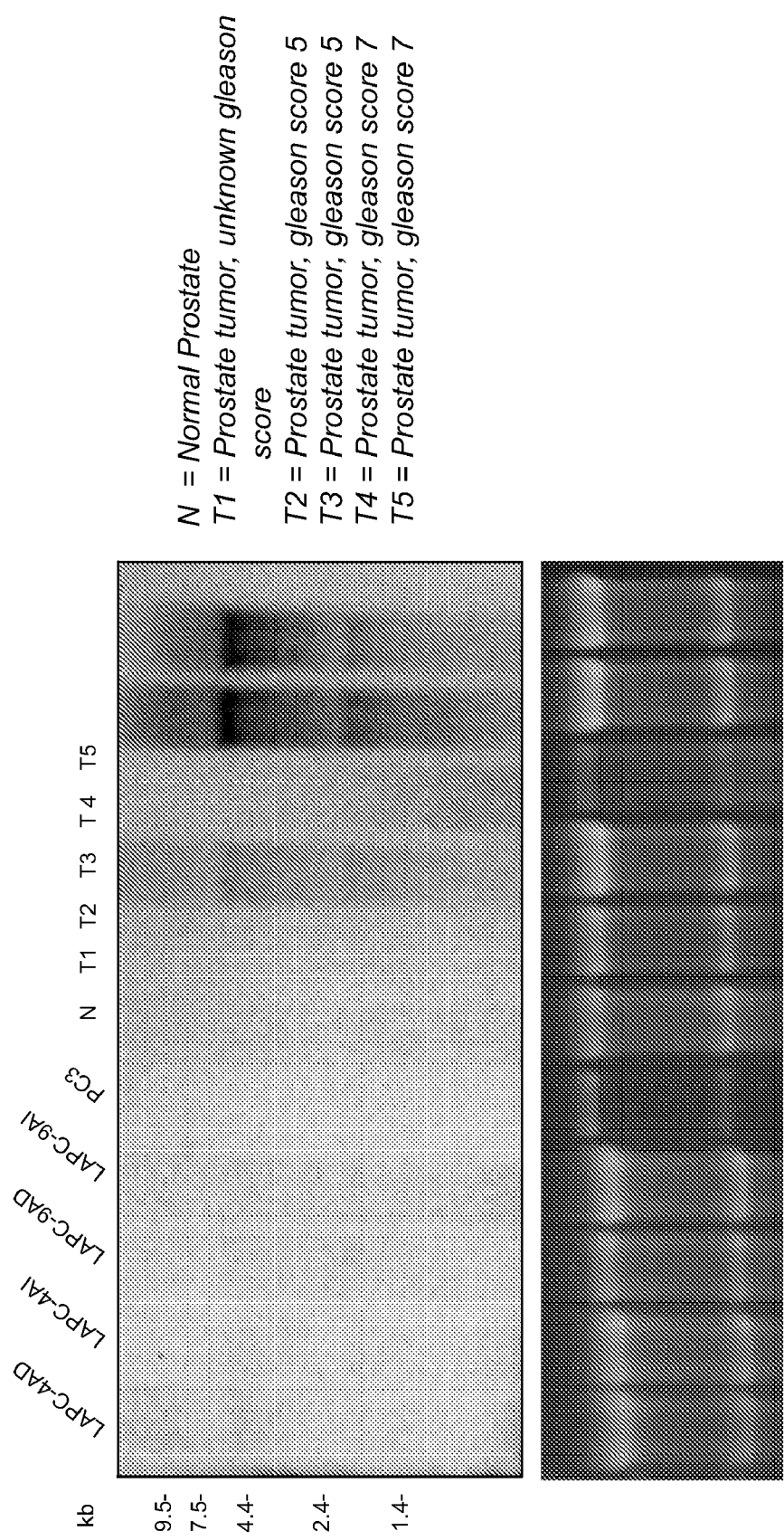
Figure 18: Expression of 238P1B2 in Prostate Cancer Patient Specimens

238P1B2 PROTEIN

CROSS-REFERENCE TO RELATED APPLICATIONS

This application is a continuation of U.S. patent application Ser. No. 10/114,669, filed Apr. 1, 2002, the contents of which is hereby incorporated by reference herein in its entirety.

SUBMISSION ON COMPACT DISC

The contents of the following submission on compact discs are incorporated herein by reference in its entirety: A compact disc copy of the Sequence Listing (COPY 1) (file name: 5115820065.txt, date recorded: Sep. 3, 2002, size: 1,448 KB); a duplicate compact disc copy of Sequence Listing (COPY 2) (file name: 5115820065.txt, date recorded: Sep. 3, 2002, size: 1,448 KB); a computer readable form copy of the Sequence Listing (CRF COPY) (file name: 5115820065.txt, date recorded: Sep. 3, 2002, size: 1,448 KB).

FIELD OF THE INVENTION

The invention described herein relates to a gene and its encoded protein, termed 238P1B2, expressed in certain cancers, and to diagnostic and therapeutic methods and compositions useful in the management of cancers that express 238P1B2.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et al., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and 8 per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer.

Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 238P1B2, that has now been found to be over-expressed in the cancer(s) listed in Table I. Northern blot expression analysis of 238P1B2 gene expression in normal tissues shows a restricted expression pattern in adult tissues. The nucleotide (FIG. 2) and amino acid (FIG. 2, and FIG. 3) sequences of 238P1B2 are provided. The tissue-related profile of 238P1B2 in normal adult tissues, combined with the over-expression observed in the tumors listed in Table I, shows that 238P1B2 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 238P1B2 genes, mRNAs, and/or coding sequences, preferably in isolated form, including polynucleotides encoding 238P1B2-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 238P1B2-related protein, as well as the peptides/proteins themselves; DNA, RNA, DNA/RNA hybrids, and related molecules, polynucleotides or oligonucleotides complementary or having at least a 90% homology to the 238P1B2 genes or mRNA sequences or parts thereof, and polynucleotides or oligonucleotides that hybridize to the 238P1B2 genes, mRNAs, or to 238P1B2-encoding polynucleotides. Also provided are means for isolating cDNAs and the genes encoding 238P1B2. Recombinant DNA molecules containing 238P1B2 polynucleotides, cells transformed or transduced with such molecules, and host-vector systems for the expression of 238P1B2 gene products are also provided. The invention further provides antibodies that bind to 238P1B2 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 238P1B2 polynucleotides and proteins in various biological samples, as well as methods for identifying cells that express 238P1B2. A typical embodiment of this invention provides methods for monitoring 238P1B2 gene products in a tissue or hematology sample having or suspected of having some form of growth dysregulation such as cancer.

The invention further provides various immunogenic or therapeutic compositions and strategies for treating cancers that express 238P1B2 such as cancers of tissues listed in Table I, including therapies aimed at inhibiting the transcription, translation, processing or function of 238P1B2 as well as cancer vaccines. In one aspect, the invention provides compositions, and methods comprising them, for treating a cancer that expresses 238P1B2 in a human subject wherein the composition comprises a carrier suitable for human use and a human unit dose of one or more than one agent that inhibits the production or function of 238P1B2. Preferably, the carrier is a uniquely human carrier. In another aspect of the invention, the agent is a moiety that is immunoreactive with 238P1B2 protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 238P1B2 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 238P1B2 as described above. The one or more than one nucleic acid molecule may also be, or encodes, a molecule that inhibits production of 238P1B2. Non-limiting examples of such molecules include, but are not limited to, those complementary to a nucleotide sequence essential for production of 238P1B2 (e.g. antisense sequences or molecules that form a triple helix with a nucleotide double helix essential for 238P1B2 production) or a ribozyme effective to lyse 238P1B2 mRNA.

BRIEF DESCRIPTION OF THE FIGURES

FIG. 1. The 238P1B2 SSH sequence of 210 nucleotides (SEQ ID: 8869).

FIG. 2. The cDNA (SEQ ID: 8870) and amino acid sequence (SEQ ID: 8871) of 238P1B2 variant 1A is shown in FIG. 2A. The start methionine is underlined. The open reading frame extends from nucleic acids 2133 to 2897 including the stop codon. The nucleic acid (SEQ ID: 8872) and amino acid sequence (SEQ ID: 8873) of 238P1B2 variant 1B is shown in FIG. 2B. The open reading frame extends from nucleic acid 1947 to 2897 including the stop codon. The nucleic acid (SEQ ID: 8874) and amino acid (SEQ ID: 8875) sequence of 238P1B2 variant 2 is shown in FIG. 2C; the codon for the start methionine is underlined. The open reading frame extends from nucleic acid 2133 to 2897 including the stop codon. The nucleic acid (SEQ ID: 8876) and amino acid (SEQ ID: 8877) sequence of 238P1B2 variant 3 is shown in FIG. 2D, the codon for the start methionine is underlined. The open reading frame extends from nucleic acid 2133 to 2897 including the stop codon. The nucleic acid (SEQ ID: 8878) and amino acid (SEQ ID: 8879) sequence of 238P1B2 variant 4 is shown in FIG. 2E; the codon for the start methionine is underlined. The open reading frame extends from nucleic acid 2133 to 2897 including the stop codon. The nucleic acid (SEQ ID: 8880) and amino acid (SEQ ID: 8881) sequence of 238P1B2 variant 5 is shown in FIG. 2F; the codon for the start methionine is underlined. The open reading frame extends from nucleic acid 2133 to 2897 including the stop codon. The nucleic acid (SEQ ID: 8882) and amino acid (SEQ ID: 8883) sequence of 238P1B2 variant 6 is shown in FIG. 2G, the codon for the start methionine is underlined. The open reading frame extends from nucleic acid 2133 to 2897 including the stop codon.

FIG. 3. Amino acid sequence of 238P1B2 variant 1A (SEQ ID: 8884) is shown in FIG. 3A; it has 254 amino acids. The amino acid sequence of 238P1B2 variant 1B (SEQ ID: 8885) is shown in FIG. 3B; it has 316 amino acids. The amino acid sequence of 238P1B2 variant 2 (SEQ ID: 8886) is shown in FIG. 3C; it has 254 amino acids.

FIG. 4. A. Nucleic Acid sequence alignment of 238P1B2 variant 1 (SEQ ID: 8887) with mouse olfactory receptor MOR14-1 (SEQ ID: 8888). B. Nucleic Acid sequence alignment of 238P1B2 variant 1 (SEQ ID: 8889) with mouse olfactory receptor MOR14-10 (SEQ ID: 8890). C. Amino Acid sequence alignment of 238P1B2 v.1A (SEQ ID: 8891) with mouse olfactory receptor MOR14-1 (SEQ ID: 8892). D. Amino Acid sequence alignment of 238P1B2 v.1A (SEQ ID: 8893) with prostate specific GPCR PHOR-1 (SEQ ID: 8894). E. Amino acid sequence alignment of 238P1B2 variant I (SEQ ID: 8895) with human olfactory receptor 5112 (SEQ ID: 8896). F. Amino Acid sequence Clustal Alignment of the three 238P1B2 variants (238P1B2 v.1A (SEQ ID: 8897); 238P1B2 v.1B (SEQ ID: 8898); 238P1B2 v.2 (SEQ ID: 8899)), depicting that 238P1B2 V1B contains an additional 62 aa at its N-terminus relative to V1A, and that 238P1B2 V2 carries a I to T point mutation at aa 225 relative to V1A FIG. 5. Hydrophilicity amino acid profile of A) 238P1B2 and B) 238P1B2 var1A determined by computer algorithm sequence analysis using the method of Hopp and Woods (Hopp T. P., Woods K. R., 1981. Proc. Natl. Acad. Sci. U.S.A. 78:3824-3828) accessed on the Protscale website on the world wide web through the ExPasy molecular biology server.

FIG. 11. Schematic display of protein variants of 238P1B2. Nucleotide variant 238P1B2 v.1 in FIG. 10 codes for protein variants 238P1B2 v.1A and v.1B. Nucleotide variant 238P1B2 v.2 in FIG. 10 codes for protein variant 238P1B2 v.2. Black box shows the same sequence as 238P1B2 v.1. Numbers in "( )" underneath the box correspond to those of 238P1B2 v.1A. Single amino acid differences are indicated above the box.

Figure 5A:
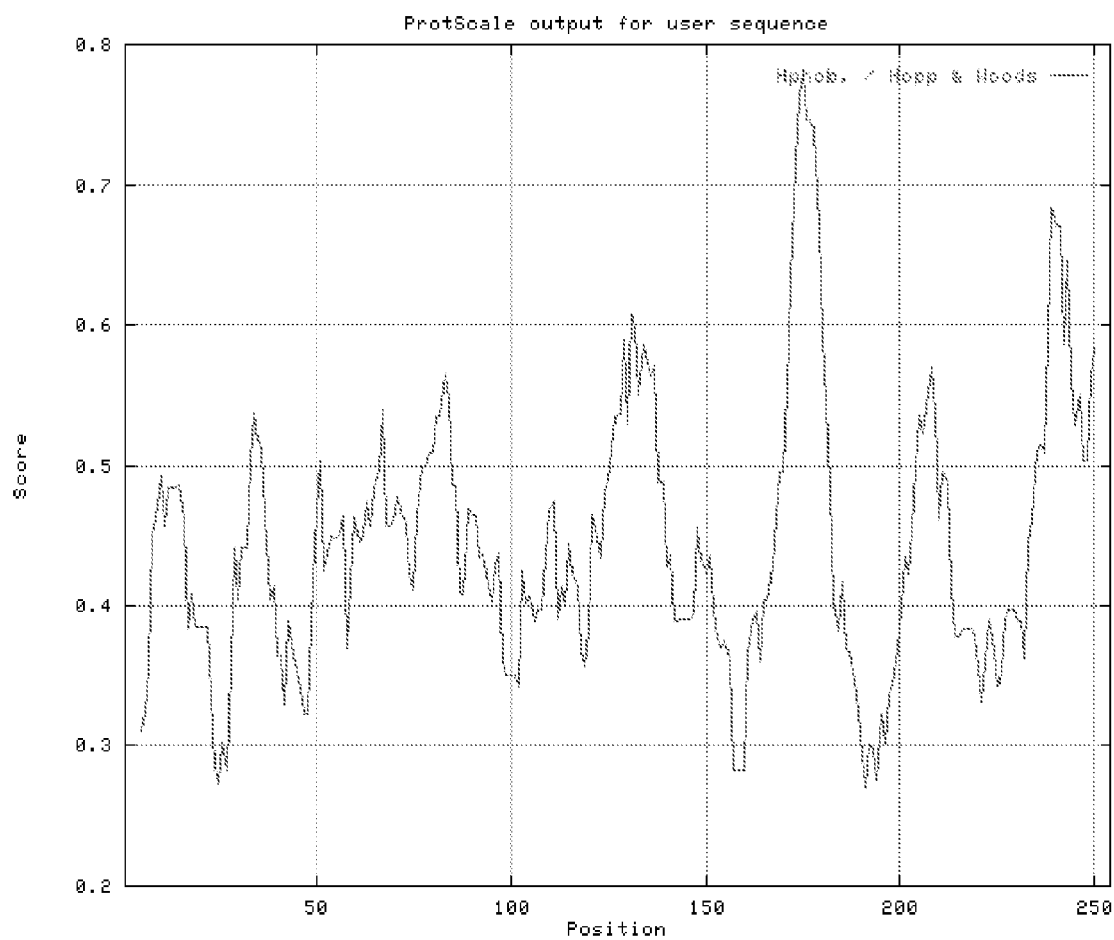

C, D, E, F. Transmembrane prediction for 238P1B2 variant 1a and 1b. C, E. Schematic representations of the probability of existence of transmembrane regions and orientation of 238P1B2 variant 1a (C) and variant 1b (E) based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). D, F. Schematic representation of the probability of the existence of transmembrane regions and the extracellular and intracellular orientation of 238P1B2 variant 1a (D) and variant 1b (F) based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server. The results of the transmembrane prediction programs presented depict 238P1B2 variant 1a as most likely containing 6 transmembrane domains and variant 1b 7 transmembrane domains.

FIG. 13: Probable topology and structure of 238P1B2 variants 1 and 1B.

FIG. 14. Expression of 238P1B2 by RT-PCR. First strand cDNA was prepared from vital pool 1 (liver, lung and kidney), vital pool 2 (pancreas, colon and stomach), and prostate cancer pool. Normalization was performed by PCR using primers to actin and GAPDH. Semi-quantitative PCR, using primers to 238P1B2, was performed at 26 and 30 cycles of amplification. Results show strong expression of 238P1B2 in prostate cancer pool but not in vital pool 1 and vital pool 2.

FIG. 15. Expression of 238P1B2 in normal tissues. Two multiple tissue northern blots (Clontech) both with 2 μg of mRNA/lane were probed with the 238P1B2 SSH fragment. Size standards in kilobases (kb) are indicated on the side. Results show absence of 238P1B2 expression in all 16 normal tissues tested.

FIG. 16. Expression of 238P1B2 in Multiple Normal Tissues. An mRNA dot blot containing 76 different samples from human tissues was analyzed using a 238P1B2 SSH probe. Expression was only detected in placenta.

FIG. 17. Expression of 238P1B2 in Human Patient Cancer Specimens and Normal Tissues. RNA was extracted from a pool of three prostate cancer patient specimens, as well as from normal prostate (NP), normal bladder (NB), normal kidney (NK), normal colon (NC), normal lung (NL), normal breast (NBr), and normal ovary (NO. Northern blot with 10 μg of total RNA/lane was probed with 238P1B2 SSH sequence. Size standards in kilobases (kb) are indicated on the side. The results show expression of 238P1B2 in the prostate cancer pool and normal ovary.

FIG. 18. Expression of 238P1B2 in prostate cancer patient tissues. RNA was extracted from normal prostate (N), prostate cancer xenografts (LAPC-4AD, LAPC-4AI, LAPC-9AD, LAPC-9AI), prostate cancer cell lines (LNCaP and PC3), and prostate cancer patient tumors (T). Northern blots with 10 μg of total RNA were probed with the 238P1B2 SSH fragment. Size standards in kilobases are on the side. Results show strong expression of 238P1B2 in prostate tumor tissues. The lower panel represents the ethidium bromide staining of the gel.

DETAILED DESCRIPTION OF THE INVENTION

Outline of Sections
I.) Definitions
II.) 238P1B2 Polynucleotides
II.A.) Uses of 238P1B2 Polynucleotides
   II.A.1.) Monitoring of Genetic Abnormalities
   II.A.2.) Antisense Embodiments
   II.A.3.) Primers and Primer Pairs
   II.A.4.) Isolation of 238P1B2-Encoding Nucleic Acid Molecules
   II.A.5.) Recombinant Nucleic Acid Molecules and Host-Vector Systems
III.) 238P1B2-related Proteins
III.A.) Motif-bearing Protein Embodiments
III.B.) Expression of 238P1B2-related Proteins
III.C.) Modifications of 238P1B2-related Proteins
III.D.) Uses of 238P1B2-related Proteins
IV.) 238P1B2 Antibodies
V.) 238P1B2 Cellular Immune Responses
VI.) 238P1B2 Transgenic Animals
VII.) Methods for the Detection of 238P1B2
VIII.) Methods for Monitoring the Status of 238P1B2-related Genes and Their Products
IX.) Identification of Molecules That Interact With 238P1B2
X.) Therapeutic Methods and Compositions
X.A.) Anti-Cancer Vaccines
X.B.) 238P1B2 as a Target for Antibody-Based Therapy
X.C.) 238P1B2 as a Target for Cellular Immune Responses
   X.C.1. Minigene Vaccines
   X.C.2. Combinations of CTL Peptides with Helper Peptides
   X.C.3. Combinations of CTL Peptides with T Cell Priming Agents
   X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 238P1B2.
XII.) Inhibition of 238P1B2 Protein Function
XII.A.) Inhibition of 238P1B2 With Intracellular Antibodies
XII.B.) Inhibition of 238P1B2 with Recombinant Proteins
XII.C.) Inhibition of 238P1B2 Transcription or Translation
XII.D.) General Considerations for Therapeutic Strategies
XIII.) KITS I.) Definitions:

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 238P1B2 (either by removing the underlying glycosylation site or by deleting the glycosylation by chemical and/or enzymatic means), and/or adding one or more glycosylation sites that are not present in the native sequence 238P1B2. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 238P1B2-related protein). For example an analog of a 238P1B2 protein can be specifically bound by an antibody or T cell that specifically binds to 238P1B2.

The term "antibody" is used in the broadest sense. Therefore an "antibody" can be naturally occurring or man-made such as monoclonal antibodies produced by conventional hybridoma technology. Anti-238P1B2 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-238P1B2 antibodies and clones thereof (including agonist, antagonist and neutralizing antibodies) and anti-238P1B2 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to maytansinoids, yttrium, bismuth, ricin, ricin A-chain, doxorubicin, daunorubicin, taxol, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alphasarcin, gelonin, mitogellin, retstrictocin, phenomycin, enomycin, curicin, crotin, calicheamicin, sapaonaria officinalis inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu. Antibodies may also be conjugated to an anti-cancer pro-drug activating enzyme capable of converting the prodrug to its active form.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/ 100 µg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 238P1B2 genes or that encode polypeptides other than 238P1B2 gene product or fragments thereof. A skilled artisan can readily employ nucleic acid isolation procedures to obtain an isolated 238P1B2 polynucleotide. A protein is said to be "isolated," for example, when physical, mechanical or chemical methods are employed to remove the 238P1B2 proteins from cellular constituents that are normally associated with the protein. A skilled artisan can readily employ standard purification methods to obtain an isolated 238P1B2 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage T×N×M+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of an 238P1B2-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymine (T), as shown for example in FIG. 2, can also be uracil (U); this definition pertains to the differences between the chemical structures of DNA and RNA, in particular the observation that one of the four major bases in RNA is uracil (U) instead of thymine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. In another embodiment, for example, the primary anchor residues of a peptide that will bind an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

A "recombinant" DNA or RNA molecule is a DNA or RNA molecule that has been subjected to molecular manipulation in vitro.

Non-limiting examples of small molecules include compounds that bind or interact with 238P1B2, ligands including hormones, neuropeptides, chemokines, odorants, phospholipids, and functional equivalents thereof that bind and preferably inhibit 238P1B2 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 238P1B2 protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles.

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino acid residues in the corresponding position(s) of a specifically described protein (e.g. the 238P1B2 protein shown in FIG. 2 or FIG. 3. An analog is an example of a variant protein. Splice isoforms and single nucleotides polymorphisms (SNPs) are further examples of variants.

The "238P1B2-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 238P1B2 proteins or fragments thereof, as well as fusion proteins of a 238P1B2 protein and a heterologous polypeptide are also included. Such 238P1B2 proteins are collectively referred to as the 238P1B2-related proteins, the proteins of the invention, or 238P1B2. The term "238P1B2-related protein" refers to a polypeptide fragment or an 238P1B2 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100 or more than 100 amino acids.

II.) 238P1B2 Polynucleotides

One aspect of the invention provides polynucleotides corresponding or complementary to all or part of an 238P1B2 gene, mRNA, and/or coding sequence, preferably in isolated form, including polynucleotides encoding an 238P1B2-related protein and fragments thereof, DNA, RNA, DNA/RNA hybrid, and related molecules, polynucleotides or oligonucleotides complementary to an 238P1B2 gene or mRNA sequence or a part thereof, and polynucleotides or oligonucleotides that hybridize to an 238P1B2 gene, mRNA, or to an 238P1B2 encoding polynucleotide (collectively, "238P1B2 polynucleotides"). In all instances when referred to in this section, T can also be U in FIG. 2.

Figure 5B:
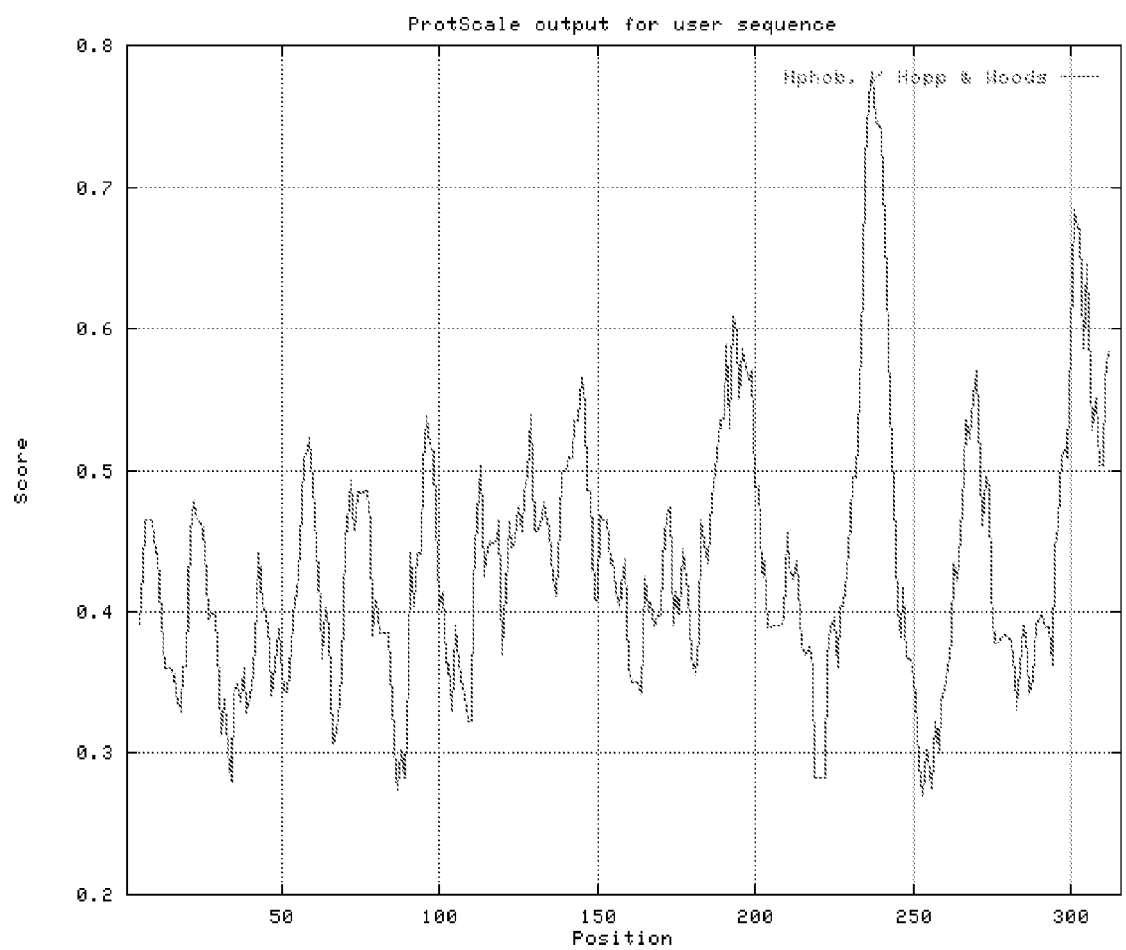
Figure 6A:
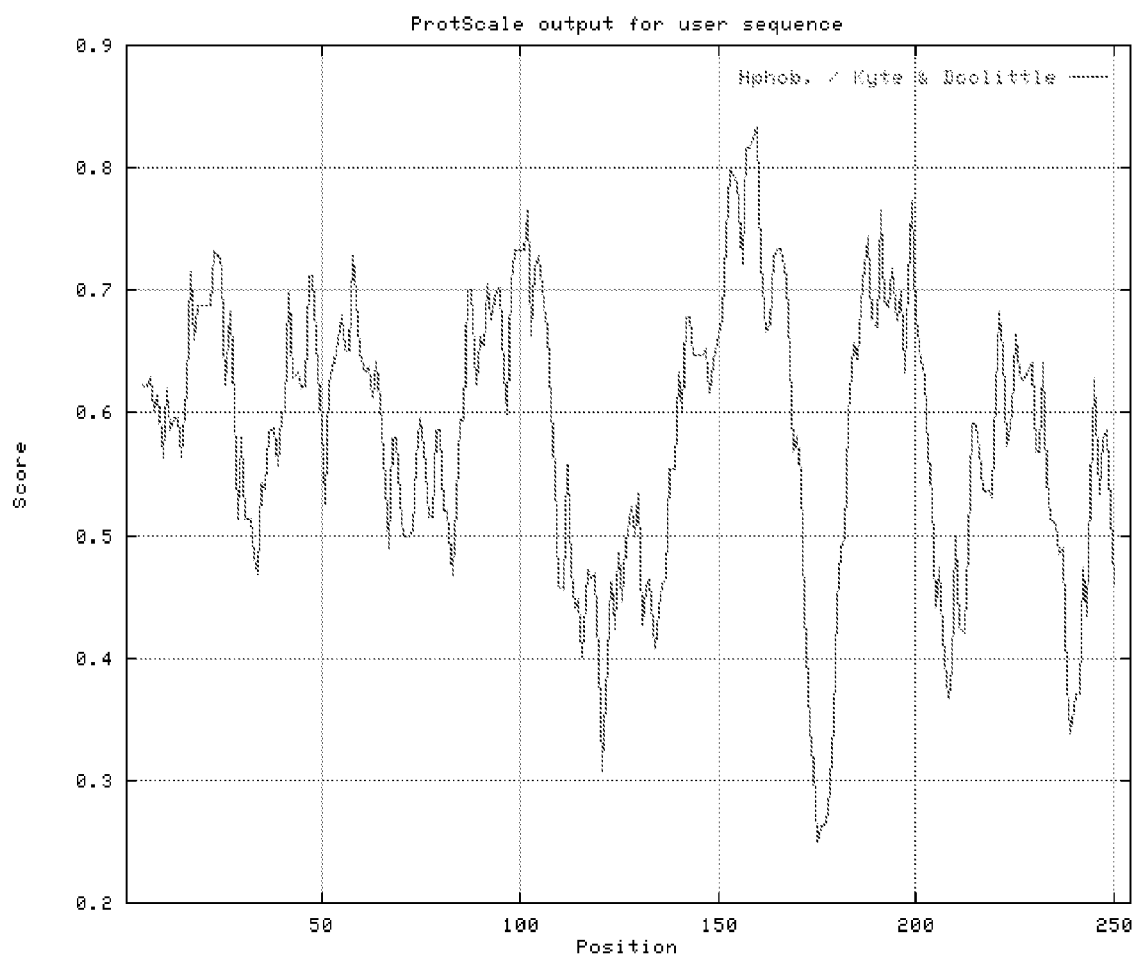
FIG. 6. Hydropathicity amino acid profile of A) 238P1B2 and B) 238P1B2 var1A determined by computer algorithm sequence analysis using the method of Kyte and Doolittle (Kyte J., Doolittle R. F., 1982. J. Mol. Biol. 157:105-132) accessed on the ProtScale website on the world wide web through the ExPasy molecular biology server.
Figure 6B:
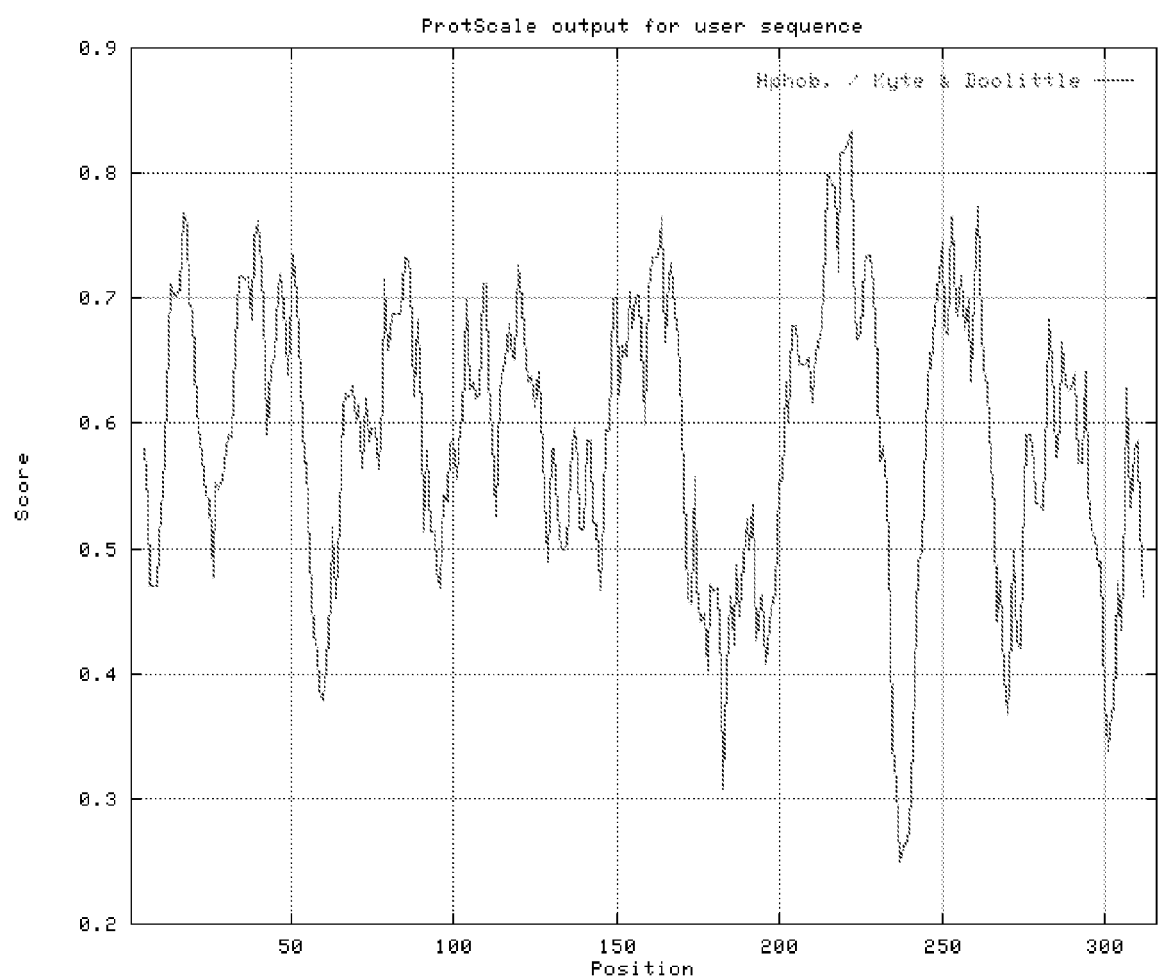
Figure 7A:
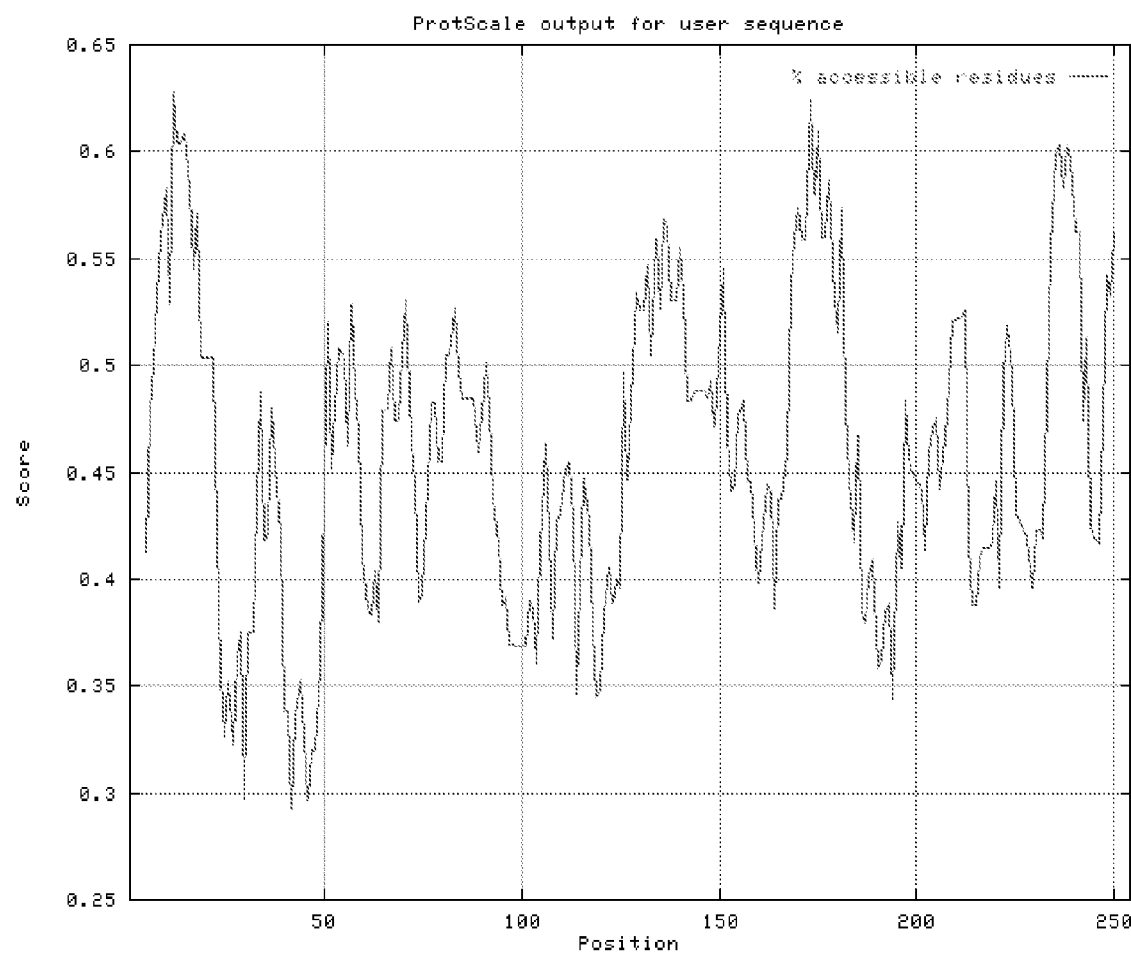
FIG. 7. Percent accessible residues amino acid profile of A) 238P1B2 and B) 238P1B2 var1A determined by computer algorithm sequence analysis using the method of Janin (Janin J., 1979 Nature 277:491-492) accessed on the ProtScale website on the world wide web through the ExPasy molecular biology server.
Figure 7B:
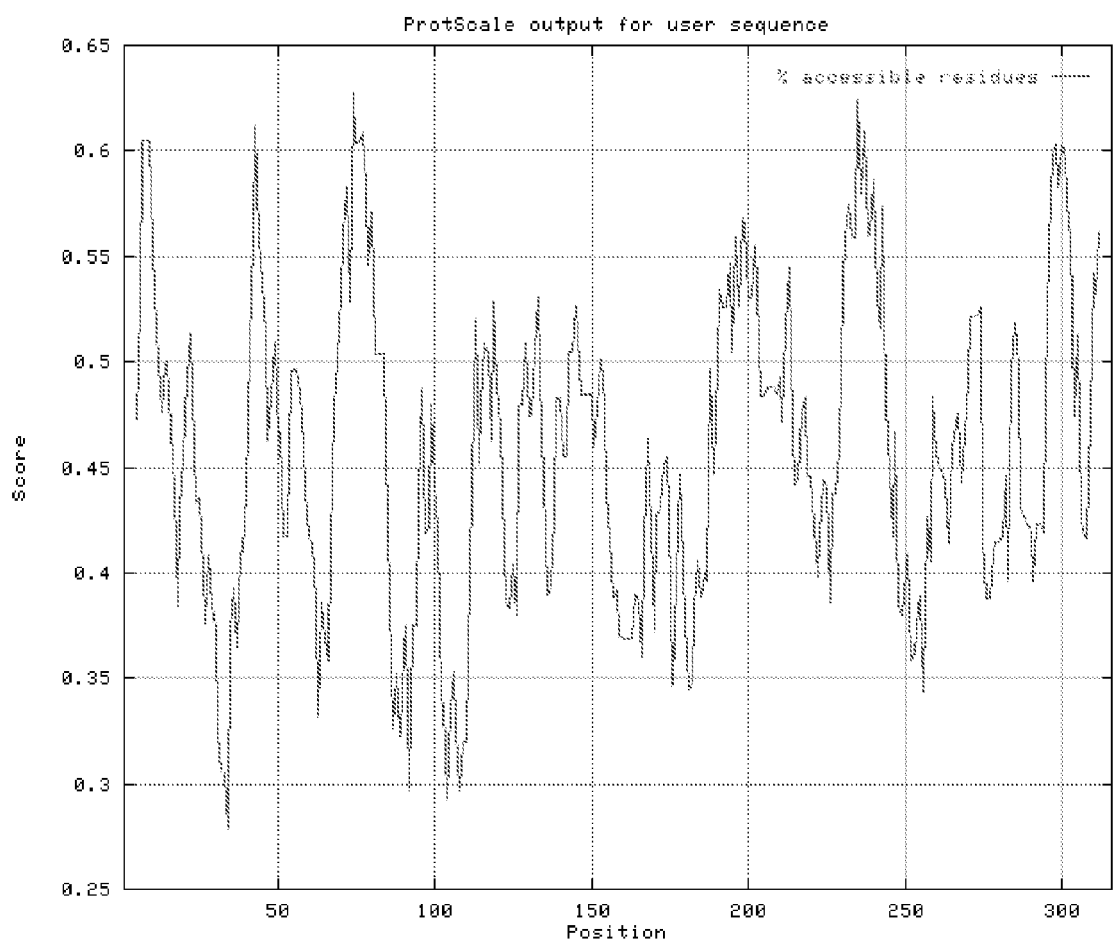
Figure 8A:
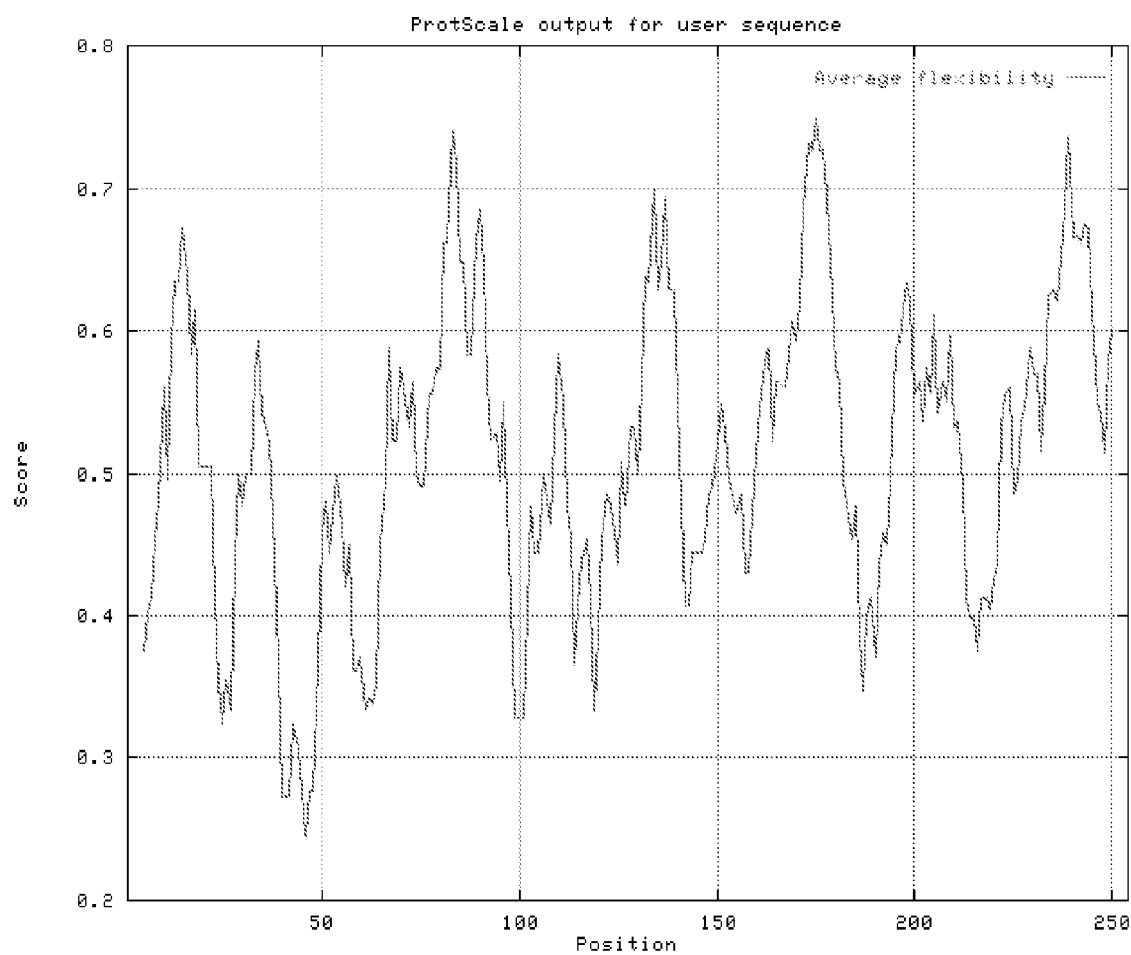
FIG. 8. Average flexibility amino acid profile of A) 238P1B2 and B) 238P1B2 var1A determined by computer algorithm sequence analysis using the method of Bhaskaran and Ponnuswamy (Bhaskaran R., and Ponnuswamy P. K., 1988. Int. J. Pept. Protein Res. 32:242-255) accessed on the ProtScale website on the world wide web (.expasy.ch/cgi-bin/protscale.pl) through the ExPasy molecular biology server.
Figure 8B:
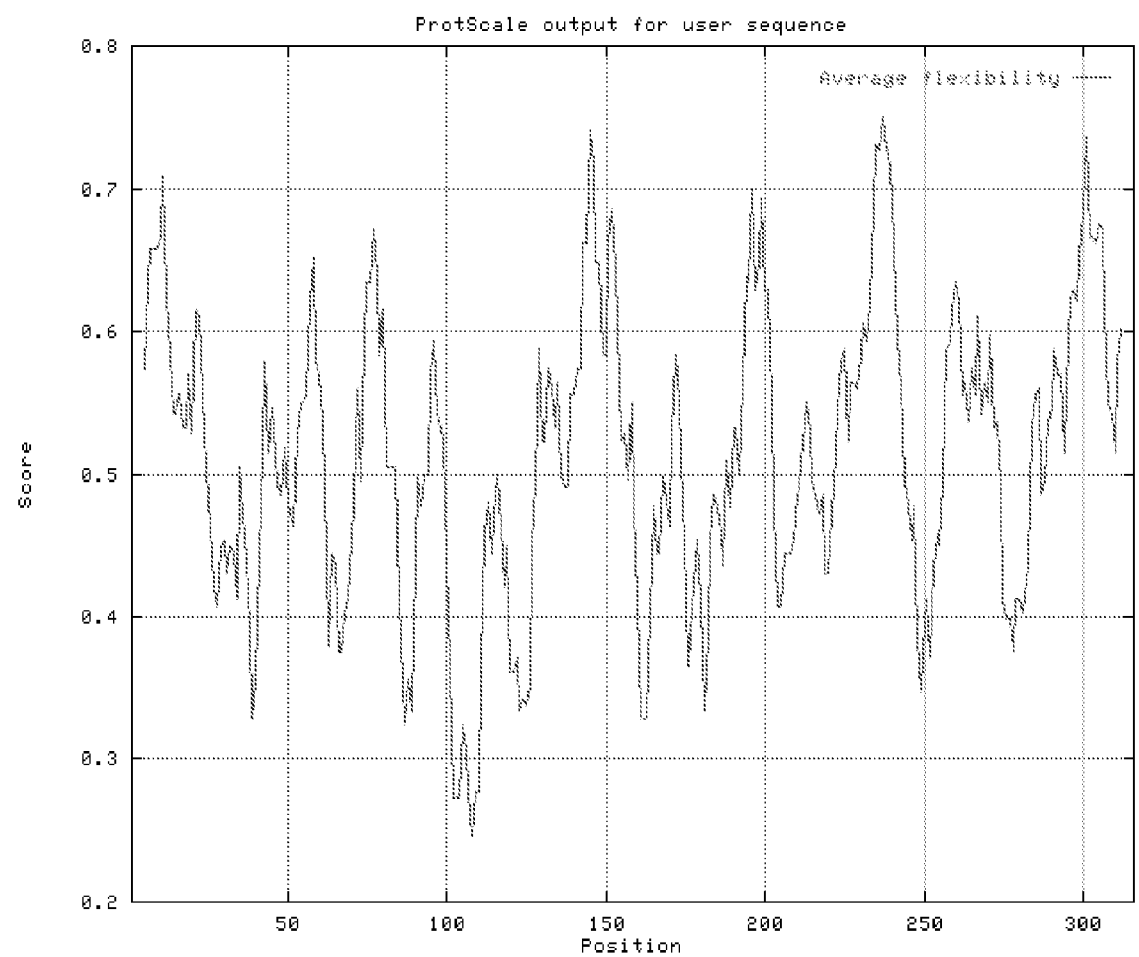
Figure 9A:
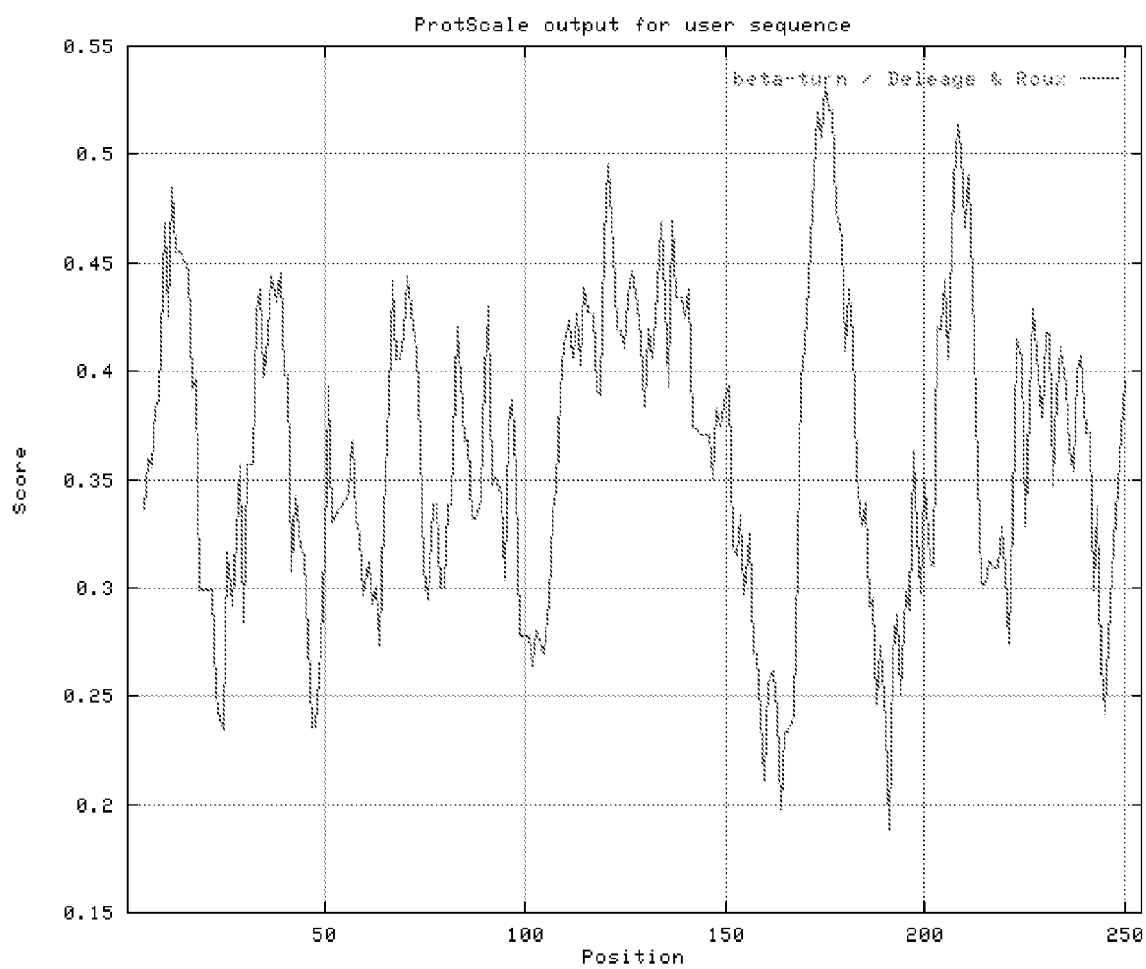
FIG. 9. Beta-turn amino acid profile of A) 238P1B2 and B) 238P1B2 var1A determined by computer algorithm sequence analysis using the method of Deleage and Roux (Deleage, G., Roux B. 1987 Protein Engineering 1:289-294) accessed on the ProtScale website through the ExPasy molecular biology server.
Figure 9B:
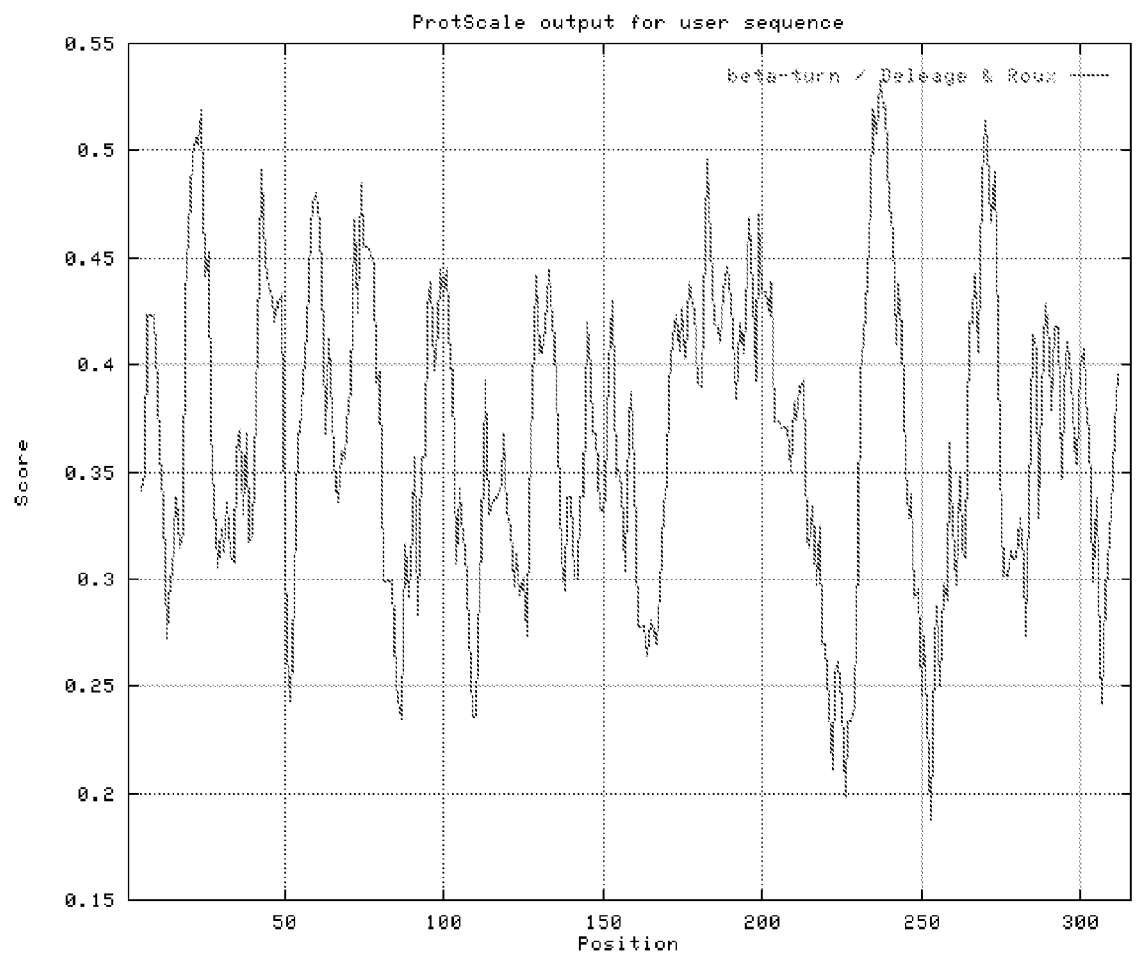

Embodiments of a 238P1B2 polynucleotide include: a 238P1B2 polynucleotide having the sequence shown in FIG. 2, the nucleotide sequence of 238P1B2 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 238P1B2 nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 2133 through nucleotide residue number 2894, followed by a stop codon, wherein T can also be U;

(III) a polynucleotide comprising, consisting essentially of, or consisting of the sequence as shown in FIG. 2B, from nucleotide residue number 1947 through nucleotide residue number 2894, followed by a stop codon, wherein T can also be U;

(IV) a polynucleotide comprising, consisting essentially of, or consisting of the sequence as shown in FIG. 2C, from nucleotide residue number 2133 through nucleotide residue number 2894, followed by a stop codon, wherein T can also be U;

(V) a polynucleotide comprising, consisting essentially of, or consisting of the sequence as shown in FIG. 2D, from nucleotide residue number 2133 through nucleotide residue number 2894, followed by a stop codon, wherein T can also be U;

(VI) a polynucleotide comprising, consisting essentially of, or consisting of the sequence as shown in FIG. 2E, from nucleotide residue number 2133 through nucleotide residue number 2894, followed by a stop codon, wherein T can also be U;

(VII) a polynucleotide comprising, consisting essentially of, or consisting of the sequence as shown in FIG. 2F, from nucleotide residue number 2133 through nucleotide residue number 2894, followed by a stop codon, wherein T can also be U;

(VIII) a polynucleotide comprising, consisting essentially of, or consisting of the sequence as shown in FIG. 2G, from nucleotide residue number 2133 through nucleotide residue number 2894, followed by a stop codon, wherein T can also be U;

(IX) a polynucleotide that encodes an 238P1B2-related protein that is at least 90% homologous to an entire amino acid sequence shown in FIG. 2A-G;

(X) a polynucleotide that encodes an 238P1B2-related protein that is at least 90% identical to an entire amino acid sequence shown in FIG. 2A-G;

(XI) a polynucleotide that encodes at least one peptide set forth in Tables V-XVIII or Table XIX;

(XII) a polynucleotide that encodes a peptide region of at least 5 amino acids of a peptide of FIG. 3A in any whole number increment up to 254 that includes an amino acid position having a value greater than 0.5 in the Hydrophilicity profile of FIG. 5A, or of FIG. 3B in any whole number increment up to 316 that includes an amino acid position having a value greater than 0.5 in the Hydrophilicity profile of FIG. 5B;

(XIII) a polynucleotide that encodes a peptide region of at least S amino acids of a peptide of FIG. 3A in any whole number increment up to 254 that includes an amino acid position having a value less than 0.5 in the Hydropathicity profile of FIG. 6A, or of FIG. 3B in any whole number increment up to 316, that includes an amino acid position having a value less than 0.5 in the Hydropathicity profile of FIG. 6B;

(XIV) a polynucleotide that encodes a peptide region of at least S amino acids of a peptide of FIG. 3A in any whole number increment up to 254 that includes an amino acid position having a value greater than 0.5 in the Percent Accessible Residues profile of FIG. 7A, or of FIG. 3B in any whole number increment up to 316, that includes an amino acid position having a value greater than 0.5 in the Percent Accessible Residues profile of FIG. 7B;

(XV) a polynucleotide that encodes a peptide region of at least 5 amino acids of a peptide of FIG. 3A in any whole number increment up to 254 that includes an amino acid position having a value greater than 0.5 in the Average Flexibility profile on FIG. 8A, or of FIG. 3B in any whole number increment up to 316, that includes an amino acid position having a value greater than 0.5 in the Average Flexibility profile on FIG. 8B;

(XVI) a polynucleotide that encodes a peptide region of at least 5 amino acids of a peptide of FIG. 3A in any whole number increment up to 254 that includes an amino acid position having a value greater than 0.5 in the Beta-turn profile of FIG. 9A, or of FIG. 3B in any whole number increment up to 316, that includes an amino acid position having a value greater than 0.5 in the Beta-turn profile of FIG. 9B;

(XVII) a polynucleotide that encodes a 238P1B2-related protein whose sequence is encoded by the cDNAs contained in the plasmid deposited with American Type Culture Collection as Accession No. PTA-4124 on Mar. 7, 2002;

(XVIII) a polynucleotide that is fully complementary to a polynucleotide of any one of (I)—(XVII);

(XIX) a polynucleotide that selectively hybridizes under stringent conditions to a polynucleotide of (I)-(XVIII);

(XX) a peptide that is encoded by any of (I)-(XIX); and, (XXI) a polynucleotide of any of (I)-(XIX) or peptide of (XX) together with a pharmaceutical excipient and/or in a human unit dose form.

As used herein, a range is understood to specifically disclose all whole unit positions thereof.

Typical embodiments of the invention disclosed herein include 238P1B2 polynucleotides that encode specific portions of 238P1B2 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, or 254 contiguous amino acids of 238P1B2;

(b) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, or 254 contiguous amino acids of variant 1A;

(c) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, or 316 contiguous amino acids of variant 1B; or (d) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, or 254 contiguous amino acids of variant 2.

For example, representative embodiments of the invention disclosed herein include: polynucleotides and their encoded peptides themselves encoding about amino acid 1 to about amino acid 10 of the 238P1B2 protein or variants shown in FIG. 2 or FIG. 3, polynucleotides encoding about amino acid 10 to about amino acid 20 of the 238P1B2 protein or variants shown in FIG. 2 or FIG. 3, polynucleotides encoding about amino acid 20 to about amino acid 30 of the 238P1B2 protein or variants shown in FIG. 2 or FIG. 3, polynucleotides encoding about amino acid 30 to about amino acid 40 of the 238P1B2 protein or variants shown in FIG. 2 or FIG. 3, polynucleotides encoding about amino acid 40 to about amino acid 50 of the 238P1B2 protein or variants shown in FIG. 2 or FIG. 3, polynucleotides encoding about amino acid 50 to about amino acid 60 of the 238P1B2 protein or variants shown in FIG. 2 or FIG. 3, polynucleotides encoding about amino acid 60 to about amino acid 70 of the 238P1B2 protein or variants shown in FIG. 2 or FIG. 3, polynucleotides encoding about amino acid 70 to about amino acid 80 of the 238P1B2 protein or variants shown in FIG. 2 or FIG. 3, polynucleotides encoding about amino acid 80 to about amino acid 90 of the 238P1B2 protein or variants shown in FIG. 2 or FIG. 3, polynucleotides encoding about amino acid 90 to about amino acid 100 of the 238P1B2 protein or variants shown in FIG. 2 or FIG. 3, or encoding regions from about amino acid 100 to amino acids later in the sequence, in increments of about 10 amino acids, ending at the carboxyl terminal amino acid set forth in FIG. 2 or FIG. 3. Accordingly polynucleotides encoding portions of the amino acid sequence (of about 10 amino acids), of amino acids 100 through the carboxyl terminal amino acid of the 238P1B2 protein are embodiments of the invention. Wherein it is understood that each particular amino acid position discloses that position plus or minus five amino acid residues.

Polynucleotides encoding relatively long portions of a 238P1B2 protein are also within the scope of the invention. For example, polynucleotides encoding from about amino acid I (or 20 or 30 or 40 etc.) to about amino acid 20, (or 30, or 40 or 50 etc.) of the 238P1B2 protein or variants shown in FIG. 2 or FIG. 3 can be generated by a variety of techniques well known in the art. These polynucleotide fragments can include any portion of the 238P1B2 sequence or variants as shown in FIG. 2.

Additional illustrative embodiments of the invention disclosed herein include 238P1B2 polynucleotide fragments encoding one or more of the biological motifs contained within a 238P1B2 protein sequence or variant sequence, including one or more of the motif-bearing subsequences of a 238P1B2 protein or variant set forth in Tables V-XVIII and Table XIX.

Note that to determine the starting position of any peptide set forth in Tables V-XVIII and Table XIX (collectively HLA Peptide Tables) respective to its parental protein, e.g., variant 1, variant 2, etc., reference is made to three factors: the particular variant, the length of the peptide in an HLA Peptide Table, and the Search Peptides listed at the beginning of Table XIX. Generally, a unique Search Peptide is used to obtain HLA peptides for a particular variant. The position of each Search Peptide relative to its respective parent molecule is listed at the beginning of Table XIX. Accordingly if a Search Peptide begins at position "X", one must add the value "X−1" to each position in Tables V-XVIII and Table XIX to obtain the actual position of the HLA peptides in their parental molecule. For example if a particular Search Peptide begins at position 150 of its parental molecule, one must add 150-1, i.e., 149 to each HLA peptide amino acid position to calculate the position of that amino acid in the parent molecule.

One embodiment of the invention comprises an HLA peptide, that occurs at least twice in Tables V-XVIII and Table XIX collectively, or an oligonucleotide that encodes the HLA peptide. Another embodiment of the invention comprises an HLA peptide that occurs at least once in Tables V-XVIII and at least once in Table XIX, or an oligonucleotide that encodes the HLA peptide.

Another embodiment of the invention is antibody epitopes which comprise a peptide region, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

In another embodiment, typical polynucleotide fragments of the invention encode one or more of the regions of 238P1B2 protein or variant that exhibit homology to a known molecule. In another embodiment of the invention, typical polynucleotide fragments can encode one or more of the 238P1B2 protein or variant N-glycosylation sites, cAMP and cGMP-dependent protein kinase phosphorylation sites, casein kinase II phosphorylation sites or N-myristoylation site and amidation sites.

II.A.) Uses of 238P1B2 Polynucleotides

II.A.I.) Monitoring of Genetic Abnormalities

The polynucleotides of the preceding paragraphs have a number of different specific uses. The human 238P1B2 gene maps to the chromosomal location set forth in Example 3. For example, because the 238P1B2 gene maps to this chromosome, polynucleotides that encode different regions of the 238P1B2 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the 238P1B2 proteins provide new tools that can be used to delineate, with greater precision than previously possible, cytogenetic abnormalities in the chromosomal region that encodes 238P1B2 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as 238P1B2 was shown to be highly expressed in bladder and other cancers, 238P1B2 polynucleotides are used in methods assessing the status of 238P1B2 gene products in normal versus cancerous tissues. Typically, polynucleotides that encode specific regions of the 238P1B2 proteins are used to assess the presence of perturbations (such as deletions, insertions, point mutations, or alterations resulting in a loss of an antigen etc.) in specific regions of the 238P1B2 gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 238P1B2. For example, antisense molecules can be RNAs or other molecules, including peptide nucleic acids (PNAs) or non-nucleic acid molecules such as phosphorothioate derivatives, that specifically bind DNA or RNA in a base pair-dependent manner. A skilled artisan can readily obtain these classes of nucleic acid molecules using the 238P1B2 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 238P1B2. See for example, Jack Cohen, Oligodeoxynucleotides, Antisense Inhibitors of Gene Expression, CRC Press, 1989; and Synthesis 1:1-5 (1988). The 238P1B2 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional 238P1B2 antisense oligonucleotides of the present invention include morpholino antisense oligonucleotides known in the art (see, e.g., Partridge et al., 1996, Antisense & Nucleic Acid Drug Development 6: 169-175).

The 238P1B2 antisense oligonucleotides of the present invention typically can be RNA or DNA that is complementary to and stably hybridizes with the first 100 5' codons or last 100 3' codons of a 238P1B2 genomic sequence or the corresponding mRNA. Absolute complementarity is not required, although high degrees of complementarity are preferred. Use of an oligonucleotide complementary to this region allows for the selective hybridization to 238P1B2 mRNA and not to mRNA specifying other regulatory subunits of protein kinase. In one embodiment, 238P1B2 antisense oligonucleotides of the present invention are 15 to 30-mer fragments of the antisense DNA molecule that have a sequence that hybridizes to 238P1B2 mRNA. Optionally, 238P1B2 antisense oligonucleotide is a 30-mer oligonucleotide that is complementary to a region in the first 10 5' codons or last 10 3' codons of 238P1B2. Alternatively, the antisense molecules are modified to employ ribozymes in the inhibition of 238P1B2 expression, see, e.g., L. A. Couture & D. T. Stinchcomb; *Trends Genet* 12: 510-515 (1996).

II.A.3.) Primers and Primer Pairs

Further specific embodiments of this nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 238P1B2 polynucleotide in a sample and as a means for detecting a cell expressing a 238P1B2 protein.

Examples of such probes include polypeptides comprising all or part of the human 238P1B2 cDNA sequence shown in FIG. 2. Examples of primer pairs capable of specifically amplifying 238P1B2 mRNAs are also described in the Examples. As will be understood by the skilled artisan, a great many different primers and probes can be prepared based on the sequences provided herein and used effectively to amplify and/or detect a 238P1B2 mRNA.

The 238P1B2 polynucleotides of the invention are useful for a variety of purposes, including but not limited to their use as probes and primers for the amplification and/or detection of the 238P1B2 gene(s), mRNA(s), or fragments thereof; as reagents for the diagnosis and/or prognosis of prostate cancer and other cancers; as coding sequences capable of directing the expression of 238P1B2 polypeptides; as tools for modulating or inhibiting the expression of the 238P1B2 gene(s) and/or translation of the 238P1B2 transcript(s); and as therapeutic agents.

The present invention includes the use of any probe as described herein to identify and isolate a 238P1B2 or 238P1B2 related nucleic acid sequence from a naturally occurring source, such as humans or other mammals, as well as the isolated nucleic acid sequence per se, which would comprise all or most of the sequences found in the probe used.

II.A.4.) Isolation of 238P1B2-Encoding Nucleic Acid Molecules

The 238P1B2 cDNA sequences described herein enable the isolation of other polynucleotides encoding 238P1B2 gene product(s), as well as the isolation of polynucleotides encoding 238P1B2 gene product homologs, alternatively spliced isoforms, allelic variants, and mutant forms of a 238P1B2 gene product as well as polynucleotides that encode analogs of 238P1B2-related proteins. Various molecular cloning methods that can be employed to isolate full length cDNAs encoding an 238P1B2 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 238P1B2 gene cDNAs can be identified by probing with a labeled 238P1B2 cDNA or a fragment thereof. For example, in one embodiment, a 238P1B2 cDNA (e.g., FIG. 2) or a portion thereof can be synthesized and used as a probe to retrieve overlapping and full-length cDNAs corresponding to a 238P1B2 gene. A 238P1B2 gene itself can be isolated by screening genomic DNA libraries, bacterial artificial chromosome libraries (BACs), yeast artificial chromosome libraries (YACs), and the like, with 238P1B2 DNA probes or primers.

II.A.5.) Recombinant Nucleic Acid Molecules and Host-Vector Systems

The invention also provides recombinant DNA or RNA molecules containing an 238P1B2 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 238P1B2 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 238P1B2 or a fragment, analog or homolog thereof can be used to generate 238P1B2 proteins or fragments thereof using any number of host-vector systems routinely used and widely known in the art.

A wide range of host-vector systems suitable for the expression of 238P1B2 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11: 1785). Using these expression vectors, 238P1B2 can be expressed in several prostate cancer and non-prostate cell lines, including for example 293, 293T, rat-1, NIH 3T3 and TsuPr1. The host-vector systems of the invention are useful for the production of a 238P1B2 protein or fragment thereof. Such host-vector systems can be employed to study the functional properties of 238P1B2 and 238P1B2 mutations or analogs.

Recombinant human 238P1B2 protein or an analog or homolog or fragment thereof can be produced by mammalian cells transfected with a construct encoding a 238P1B2-related nucleotide. For example, 293T cells can be transfected with an expression plasmid encoding 238P1B2 or fragment, analog or homolog thereof, a 238P1B2-related protein is expressed in the 293T cells, and the recombinant 238P1B2 protein is isolated using standard purification methods (e.g., affinity purification using anti-238P1B2 antibodies). In another embodiment, a 238P1B2 coding sequence is subcloned into the retroviral vector pSRαMSVtkneo and used to infect various mammalian cell lines, such as NIH 3T3, TsuPr1, 293 and rat-1 in order to establish 238P1B2 expressing cell lines. Various other expression systems well known in the art can also be employed. Expression constructs encoding a leader peptide joined in frame to a 238P1B2 coding sequence can be used for the generation of a secreted form of recombinant 238P1B2 protein.

As discussed herein, redundancy in the genetic code permits variation in 238P1B2 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.*, 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) 238P1B2-related Proteins

Another aspect of the present invention provides 238P1B2-related proteins. Specific embodiments of 238P1B2 proteins comprise a polypeptide having all or part of the amino acid sequence of human 238P1B2 as shown in FIG. 2 or FIG. 3. Alternatively, embodiments of 238P1B2 proteins comprise variant, homolog or analog polypeptides that have alterations in the amino acid sequence of 238P1B2 shown in FIG. 2 or FIG. 3.

In general, naturally occurring allelic variants of human 238P1B2 share a high degree of structural identity and homology (e.g., 90% or more homology). Typically, allelic variants of a 238P1B2 protein contain conservative amino acid substitutions within the 238P1B2 sequences described herein or contain a substitution of an amino acid from a corresponding position in a homologue of 238P1B2. One class of 238P1B2 allelic variants are proteins that share a high degree of homology with at least a small region of a particular 238P1B2 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" $2^{nd}$ ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of 238P1B2 proteins such as polypeptides having amino acid insertions, deletions and substitutions. 238P1B2 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., *Gene*, 34:315 (1985)), restriction selection mutagenesis (Wells et al., *Philos. Trans. R. Soc. London SerA*, 317:415 (1986)) or other known techniques can be performed on the cloned DNA to produce the 238P1B2 variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W.H. Freeman & Co., N.Y.); Chothia, J. Mol. Biol., 150:1 (1976)). If alanine substitution does not yield adequate amounts of variant, an isosteric amino acid can be used.

As defined herein, 238P1B2 variants, analogs or homologs, have the distinguishing attribute of having at least one epitope that is "cross reactive" with a 238P1B2 protein having an amino acid sequence of FIG. 3. As used in this sentence, "cross reactive" means that an antibody or T cell that specifically binds to an 238P1B2 variant also specifically binds to a 238P1B2 protein having an amino acid sequence set forth in FIG. 3. A polypeptide ceases to be a variant of a protein shown in FIG. 3, when it no longer contains any epitope capable of being recognized by an antibody or T cell that specifically binds to the starting 238P1B2 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135(4):2598-608.

Other classes of 238P1B2-related protein variants share 70%, 75%, 80%, 85% or 90% or more similarity with an amino acid sequence of FIG. 3, or a fragment thereof. Another specific class of 238P1B2 protein variants or analogs comprise one or more of the 238P1B2 biological motifs described herein or presently known in the art. Thus, encompassed by the present invention are analogs of 238P1B2 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 238P1B2 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 238P1B2 protein shown in FIG. 2 or FIG. 3.

Moreover, representative embodiments of the invention disclosed herein include polypeptides consisting of about amino acid 1 to about amino acid 10 of a 238P1B2 protein shown in FIG. 2 or FIG. 3, polypeptides consisting of about amino acid 10 to about amino acid 20 of a 238P1B2 protein shown in FIG. 2 or FIG. 3, polypeptides consisting of about amino acid 20 to about amino acid 30 of a 238P1B2 protein shown in FIG. 2 or FIG. 3, polypeptides consisting of about amino acid 30 to about amino acid 40 of a 238P1B2 protein shown in FIG. 2 or FIG. 3, polypeptides consisting of about amino acid 40 to about amino acid 50 of a 238P1B2 protein shown in FIG. 2 or FIG. 3, polypeptides consisting of about amino acid 50 to about amino acid 60 of a 238P1B2 protein shown in FIG. 2 or FIG. 3, polypeptides consisting of about amino acid 60 to about amino acid 70 of a 238P1B2 protein shown in FIG. 2 or FIG. 3, polypeptides consisting of about amino acid 70 to about amino acid 80 of a 238P1B2 protein shown in FIG. 2 or FIG. 3, polypeptides consisting of about amino acid 80 to about amino acid 90 of a 238P1B2 protein shown in FIG. 2 or FIG. 3, polypeptides consisting of about amino acid 90 to about amino acid 100 of a 238P1B2 protein shown in FIG. 2 or FIG. 3, etc. throughout the entirety of a 238P1B2 amino acid sequence. Moreover, polypeptides consisting of about amino acid 1 (or 20 or 30 or 40 etc.) to about amino acid 20, (or 130, or 140 or 150 etc.) of a 238P1B2 protein shown in FIG. 2 or FIG. 3 are embodiments of the invention. It is to be appreciated that the starting and stopping positions in this paragraph refer to the specified position as well as that position plus or minus 5 residues.

238P1B2-related proteins are generated using standard peptide synthesis technology or using chemical cleavage methods well known in the art. Alternatively, recombinant methods can be used to generate nucleic acid molecules that encode a 238P1B2-related protein. In one embodiment, nucleic acid molecules provide a means to generate defined fragments of a 238P1B2 protein (or variants, homologs or analogs thereof).

III.A.) Motif-bearing Protein Embodiments

Additional illustrative embodiments of the invention disclosed herein include 238P1B2 polypeptides comprising the amino acid residues of one or more of the biological motifs contained within a 238P1B2 polypeptide sequence set forth in FIG. 2 or FIG. 3. Various motifs are known in the art, and a protein can be evaluated for the presence of such motifs by a number of publicly available Internet sites (see, e.g., Epimatrix™ and Epimer™, Brown University, and BIMAS).

Motif bearing subsequences of all 238P1B2 variant proteins are set forth and identified in Tables V-XVIII and Table XIX.

Table XX sets forth several frequently occurring motifs based on pfam searches (see URL address pfam.wustl.edu/). The columns of Table XX list (1) motif name abbreviation, (2) percent identity found amongst the different member of the motif family, (3) motif name or description and (4) most common function; location information is included if the motif is relevant for location.

Polypeptides comprising one or more of the 238P1B2 motifs discussed above are useful in elucidating the specific characteristics of a malignant phenotype in view of the observation that the 238P1B2 motifs discussed above are associated with growth dysregulation and because 238P1B2 is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables V-XVIII and Table XIX. CTL epitopes can be determined using specific algorithms to identify peptides within an 238P1B2 protein that are capable of optimally binding to specified HLA alleles (e.g., Table IV; Epimatrix™ and Epimer™, Brown University, and BIMAS). Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, one can substitute out a deleterious residue in favor of any other residue, such as a preferred residue as defined in Table IV; substitute a less-preferred residue with a preferred residue as defined in Table IV; or substitute an originally-occurring preferred residue with another preferred residue as defined in Table IV. Substitutions can occur at primary anchor positions or at other positions in a peptide; see, e.g., Table IV.

A variety of references reflect the art regarding the identification and generation of epitopes in a protein of interest as well as analogs thereof. See, for example, WO 9733602 to Chesnut et al.; Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al, 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the invention include polypeptides comprising combinations of the different motifs set forth in Table XXI, and/or, one or more of the polypeptides comprising combinations of the different motifs set forth in Table XIX, and/or, one or more of the predicted CTL epitopes of Table V through Table XVIII, and/or, one or more of the T cell binding motifs known in the art. Preferred embodiments contain no insertions, deletions or substitutions either within the motifs or the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically the number of N-terminal and/or C-terminal amino acid residues on either side of a motif is between about 1 to about 100 amino acid residues, preferably 5 to about 50 amino acid residues.

238P1B2-related proteins are embodied in many forms, preferably in isolated form. A purified 238P1B2 protein molecule will be substantially free of other proteins or molecules that impair the binding of 238P1B2 to antibody, T cell or other ligand. The nature and degree of isolation and purification will depend on the intended use. Embodiments of a 238P1B2-related proteins include purified 238P1B2-related proteins and functional, soluble 238P1B2-related proteins. In one embodiment, a functional, soluble 238P1B2 protein or fragment thereof retains the ability to be bound by antibody, T cell or other ligand.

The invention also provides 238P1B2 proteins comprising biologically active fragments of a 238P1B2 amino acid sequence shown in FIG. 2 or FIG. 3. Such proteins exhibit properties of the starting 238P1B2 protein, such as the ability to elicit the generation of antibodies that specifically bind an epitope associated with the starting 238P1B2 protein; to be bound by such antibodies; to elicit the activation of HTL or CTL; and/or, to be recognized by HTL or CTL that also specifically bind to the starting protein.

238P1B2-related polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or on the basis of immunogenicity. Fragments that contain such structures are particularly useful in generating subunit-specific anti-238P1B2 antibodies, or T cells or in identifying cellular factors that bind to 238P1B2. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within an 238P1B2 protein that are capable of optimally binding to specified HLA alleles (e.g., by using the SYFPEITHI site; the listings in Table IV(A)-(E); Epimatrix™ and Epimer™, Brown University, and BIMAS). Illustrating this, peptide epitopes from 238P1B2 that are presented in the context of human MHC class I molecules HLA-A1, A2, A3, A11, A24, B7 and B35 were predicted (Tables V-XVIII, Table XIX). Specifically, the complete amino acid sequence of the 238P1B2 protein and relevant portions of other variants, i.e., for HLA Class I predictions 9 flanking residues on either side of a point mutation, and for HLA Class II predictions 14 flanking residues on either side of a point mutation, were entered into the HLA Peptide Motif Search algorithm found in the Bioinformatics and Molecular Analysis Section (BIMAS); in addition to the site SYFPEITHI.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of 238P1B2 predicted binding peptides are shown in Tables V-XVIII and Table XIX herein. In Tables V-XVIII and Table XIX, selected candidates, 9-mers, 10-mers, and 15-mers for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV are to be "applied" to a 238P1B2 protein in accordance with the invention. As used in this context "applied" means that a 238P1B2 protein is evaluated, e.g., visually or by computer-based patterns finding methods, as appreciated by those of skill in the relevant art. Every subsequence of a 238P1B2 protein of 8, 9, 10, or 11 amino acid residues that bears an HLA Class I motif, or a subsequence of 9 or more amino acid residues that bear an HLA Class II motif are within the scope of the invention.

III.B.) Expression of 238P1B2-related Proteins

In an embodiment described in the examples that follow, 238P1B2 can be conveniently expressed in cells (such as 293T cells) transfected with a commercially available expression vector such as a CMV-driven expression vector encoding 238P1B2 with a C-terminal 6×His and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted 238P1B2 protein in transfected cells. The secreted HIS-tagged 238P1B2 in the culture media can be purified, e.g., using a nickel column using standard techniques.

III.C.) Modifications of 238P1B2-related Proteins

Modifications of 238P1B2-related proteins such as covalent modifications are included within the scope of this invention. One type of covalent modification includes reacting targeted amino acid residues of a 238P1B2 polypeptide with an organic derivatizing agent that is capable of reacting with selected side chains or the N- or C-terminal residues of a 238P1B2 protein. Another type of covalent modification of a 238P1B2 polypeptide included within the scope of this invention comprises altering the native glycosylation pattern of a protein of the invention. Another type of covalent modification of 238P1B2 comprises linking a 238P1B2 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 238P1B2-related proteins of the present invention can also be modified to form a chimeric molecule comprising 238P1B2 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 238P1B2 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 238P1B2. A chimeric molecule can comprise a fusion of a 238P1B2-related protein with a polyhistidine epitope tag, which provides an epitope to which immobilized nickel can selectively bind, with cytokines or with growth factors. The epitope tag is generally placed at the amino- or carboxyl-terminus of a 238P1B2 protein. In an alternative embodiment, the chimeric molecule can comprise a fusion of a 238P1B2-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 238P1B2 polypeptide in place of at least one variable region within an Ig molecule. In a preferred embodiment, the immunoglobulin fusion includes the hinge, CH2 and CH3, or the hinge, CH1, CH2 and CH3 regions of an IgG1 molecule. For the production of immunoglobulin fusions see, e.g., U.S. Pat. No. 5,428,130 issued Jun. 27, 1995.

III.D.) Uses of 238P1B2-related Proteins

The proteins of the invention have a number of different specific uses. As 238P1B2 is highly expressed in prostate and other cancers, 238P1B2-related proteins are used in methods that assess the status of 238P1B2 gene products in normal versus cancerous tissues, thereby elucidating the malignant phenotype. Typically, polypeptides from specific regions of a 238P1B2 protein are used to assess the presence of perturbations (such as deletions, insertions, point mutations etc.) in those regions (such as regions containing one or more motifs). Exemplary assays utilize antibodies or T cells targeting 238P1B2-related proteins comprising the amino acid residues of one or more of the biological motifs contained within a 238P1B2 polypeptide sequence in order to evaluate the characteristics of this region in normal versus cancerous tissues or to elicit an immune response to the epitope. Alternatively, 238P1B2-related proteins that contain the amino acid residues of one or more of the biological motifs in a 238P1B2 protein are used to screen for factors that interact with that region of 238P1B2.

238P1B2 protein fragments/subsequences are particularly useful in generating and characterizing domain-specific antibodies (e.g., antibodies recognizing an extracellular or intracellular epitope of an 238P1B2 protein), for identifying agents or cellular factors that bind to 238P1B2 or a particular structural domain thereof, and in various therapeutic and diagnostic contexts, including but not limited to diagnostic assays, cancer vaccines and methods of preparing such vaccines.

Proteins encoded by the 238P1B2 genes, or by analogs, homologs or fragments thereof, have a variety of uses, including but not limited to generating antibodies and in methods for identifying ligands and other agents and cellular constituents that bind to an 238P1B2 gene product. Antibodies raised against an 238P1B2 protein or fragment thereof are useful in diagnostic and prognostic assays, and imaging methodologies in the management of human cancers characterized by expression of 238P1B2 protein, such as those listed in Table I. Such antibodies can be expressed intracellularly and used in methods of treating patients with such cancers. 238P1B2-related nucleic acids or proteins are also used in generating HTL or CTL responses.

Various immunological assays useful for the detection of 238P1B2 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 238P1B2-expressing cells (e.g., in radioscintigraphic imaging methods). 238P1B2 proteins are also particularly useful in generating cancer vaccines, as further described herein.

IV.) 238P1B2 Antibodies

Another aspect of the invention provides antibodies that bind to 238P1B2-related proteins. Preferred antibodies specifically bind to a 238P1B2-related protein and do not bind (or bind weakly) to peptides or proteins that are not 238P1B2-related proteins. For example, antibodies that bind 238P1B2 can bind 238P1B2-related proteins such as the homologs or analogs thereof.

238P1B2 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 238P1B2 is also expressed or overexpressed in these other cancers. Moreover, intracellularly expressed antibodies (e.g., single chain antibodies) are therapeutically useful in treating cancers in which the expression of 238P1B2 is involved, such as advanced or metastatic prostate cancers.

The invention also provides various immunological assays useful for the detection and quantification of 238P1B2 and mutant 238P1B2-related proteins. Such assays can comprise one or more 238P1B2 antibodies capable of recognizing and binding a 238P1B2-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 238P1B2 are also provided by the invention, including but not limited to radioscintigraphic imaging methods using labeled 238P1B2 antibodies. Such assays are clinically useful in the detection, monitoring, and prognosis of 238P1B2 expressing cancers such as prostate cancer.

238P1B2 antibodies are also used in methods for purifying a 238P1B2-related protein and for isolating 238P1B2 homologues and related molecules. For example, a method of purifying a 238P1B2-related protein comprises incubating an 238P1B2 antibody, which has been coupled to a solid matrix, with a lysate or other solution containing a 238P1B2-related protein under conditions that permit the 238P1B2 antibody to bind to the 238P1B2-related protein; washing the solid matrix to eliminate impurities; and eluting the 238P1B2-related protein from the coupled antibody. Other uses of 238P1B2 antibodies in accordance with the invention include generating anti-idiotypic antibodies that mimic a 238P1B2 protein.

Various methods for the preparation of antibodies are well known in the art. For example, antibodies can be prepared by immunizing a suitable mammalian host using a 238P1B2- related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 238P1B2 can also be used, such as a 238P1B2 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 238P1B2-related protein is synthesized and used as an immunogen.

In addition, naked DNA immunization techniques known in the art are used (with or without purified 238P1B2-related protein or 238P1B2 expressing cells) to generate an immune response to the encoded immunogen (for review, see Donnelly et al., 1997, Ann. Rev. Immunol. 15: 617-648).

The amino acid sequence of a 238P1B2 protein as shown in FIG. 2 or FIG. 3 can be analyzed to select specific regions of the 238P1B2 protein for generating antibodies. For example, hydrophobicity and hydrophilicity analyses of a 238P1B2 amino acid sequence are used to identify hydrophilic regions in the 238P1B2 structure. Regions of a 238P1B2 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of 238P1B2 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 238P1B2 immunogen is often conducted by injection over a suitable time period and with use of a suitable adjuvant, as is understood in the art. During the immunization schedule, titers of antibodies can be taken to determine adequacy of antibody formation.

238P1B2 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 238P1B2-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 238P1B2 protein can also be produced in the context of chimeric or complementarity determining region (CDR) grafted antibodies of multiple species origin. Humanized or human 238P1B2 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human 238P1B2 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human 238P1B2 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 238P1B2 antibodies with an 238P1B2-related protein can be established by a number of well known means, including Western blot, immunoprecipitation, ELISA, and FACS analyses using, as appropriate, 238P1B2-related proteins, 238P1B2-expressing cells or extracts thereof. A 238P1B2 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 238P1B2 epitopes are generated using methods generally known in the art. Homodimeric antibodies can also be generated by cross-linking techniques known in the art (e.g., Wolff et al., Cancer Res. 53: 2560-2565).

V.) 238P1B2 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317: 359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., *J. Immunol.* 160: 3363, 1998; Rammensee, et al., *Immunogenetics* 41:178, 1995; Rammensee et al., SYFPEITHI; Sette, A. and Sidney, J. *Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, J. *Curr. Biol.* 6:52, 1994; Ruppert et al., *Cell* 74:929-937, 1993; Kondo et al., *J. Immunol.* 155:4307-4312, 1995; Sidney et al., *J. Immunol.* 157:3480-3490, 1996; Sidney et al., *Human Immunol.* 45:79-93, 1996; Sette, A. and Sidney, J. *Immunogenetics* 1999 November; 50(3-4):201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or, the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al, *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 238P1B2 Transgenic Animals

Nucleic acids that encode a 238P1B2-related protein can also be used to generate either transgenic animals or "knock out" animals that, in turn, are useful in the development and screening of therapeutically useful reagents. In accordance with established techniques, cDNA encoding 238P1B2 can be used to clone genomic DNA that encodes 238P1B2. The cloned genomic sequences can then be used to generate transgenic animals containing cells that express DNA that encode 238P1B2. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 238P1B2 transgene incorporation with tissue-specific enhancers.

Transgenic animals that include a copy of a transgene encoding 238P1B2 can be used to examine the effect of increased expression of DNA that encodes 238P1B2. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 238P1B2 can be used to construct a 238P1B2 "knock out" animal that has a defective or altered gene encoding 238P1B2 as a result of homologous recombination between the endogenous gene encoding 238P1B2 and altered genomic DNA encoding 238P1B2 introduced into an embryonic cell of the animal. For example, cDNA that encodes 238P1B2 can be used to clone genomic DNA encoding 238P1B2 in accordance with established techniques. A portion of the genomic DNA encoding 238P1B2 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell,* 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell* 69:915 (1992)). The selected cells are then injected into a blastocyst of an animal (e.g., a mouse or rat) to form aggregation chimeras (see, e.g., Bradley, in *Teratocarcinomas and Embryonic Stem Cells: A Practical Approach*, E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombed DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 238P1B2 polypeptide.

VII.) Methods for the Detection of 238P1B2

Another aspect of the present invention relates to methods for detecting 238P1B2 polynucleotides and 238P1B2-related proteins, as well as methods for identifying a cell that expresses 238P1B2. The expression profile of 238P1B2 makes it a diagnostic marker for metastasized disease. Accordingly, the status of 238P1B2 gene products provides information useful for predicting a variety of factors including susceptibility to advanced stage disease, rate of progression, and/or tumor aggressiveness. As discussed in detail herein, the status of 238P1B2 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 238P1B2 polynucleotides in a biological sample, such as serum, bone, prostate, and other tissues, urine, semen, cell preparations, and the like. Detectable 238P1B2 polynucleotides include, for example, a 238P1B2 gene or fragment thereof, 238P1B2 mRNA, alternative splice variant 238P1B2 mRNAs, and recombinant DNA or RNA molecules that contain a 238P1B2 polynucleotide. A number of methods for amplifying and/or detecting the presence of 238P1B2 polynucleotides are well known in the art and can be employed in the practice of this aspect of the invention.

In one embodiment, a method for detecting an 238P1B2 mRNA in a biological sample comprises producing cDNA from the sample by reverse transcription using at least one primer; amplifying the cDNA so produced using an 238P1B2 polynucleotides as sense and antisense primers to amplify 238P1B2 cDNAs therein; and detecting the presence of the amplified 238P1B2 cDNA. Optionally, the sequence of the amplified 238P1B2 cDNA can be determined.

In another embodiment, a method of detecting a 238P1B2 gene in a biological sample comprises first isolating genomic DNA from the sample; amplifying the isolated genomic DNA using 238P1B2 polynucleotides as sense and antisense primers; and detecting the presence of the amplified 238P1B2 gene. Any number of appropriate sense and antisense probe combinations can be designed from a 238P1B2 nucleotide sequence (see, e.g., FIG. 2) and used for this purpose.

The invention also provides assays for detecting the presence of an 238P1B2 protein in a tissue or other biological sample such as serum, semen, bone, prostate, urine, cell preparations, and the like. Methods for detecting a 238P1B2-related protein are also well known and include, for example, immunoprecipitation, immunohistochemical analysis, Western blot analysis, molecular binding assays, ELISA, ELIFA and the like. For example, a method of detecting the presence of a 238P1B2-related protein in a biological sample comprises first contacting the sample with a 238P1B2 antibody, a 238P1B2-reactive fragment thereof, or a recombinant protein containing an antigen binding region of a 238P1B2 antibody; and then detecting the binding of 238P1B2-related protein in the sample.

Methods for identifying a cell that expresses 238P1B2 are also within the scope of the invention. In one embodiment, an assay for identifying a cell that expresses a 238P1B2 gene comprises detecting the presence of 238P1B2 mRNA in the cell. Methods for the detection of particular mRNAs in cells are well known and include, for example, hybridization assays using complementary DNA probes (such as in situ hybridization using labeled 238P1B2 riboprobes, Northern blot and related techniques) and various nucleic acid amplification assays (such as RT-PCR using complementary primers specific for 238P1B2, and other amplification type detection methods, such as, for example, branched DNA, SISBA, TMA and the like). Alternatively, an assay for identifying a cell that expresses a 238P1B2 gene comprises detecting the presence of 238P1B2-related protein in the cell or secreted by the cell. Various methods for the detection of proteins are well known in the art and are employed for the detection of 238P1B2-related proteins and cells that express 238P1B2-related proteins.

238P1B2 expression analysis is also useful as a tool for identifying and evaluating agents that modulate 238P1B2 gene expression. For example, 238P1B2 expression is significantly upregulated in prostate cancer, and is expressed in cancers of the tissues listed in Table I. Identification of a molecule or biological agent that inhibits 238P1B2 expression or over-expression in cancer cells is of therapeutic value. For example, such an agent can be identified by using a screen that quantifies 238P1B2 expression by RT-PCR, nucleic acid hybridization or antibody binding.

VIII.) Methods for Monitoring the Status of 238P1B2-related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23: 19-32 (1995)). In this context, examining a biological sample for evidence of dysregulated cell growth (such as aberrant 238P1B2 expression in cancers) allows for early detection of such aberrant physiology, before a pathologic state such as cancer has progressed to a stage that therapeutic options are more limited and or the prognosis is worse. In such examinations, the status of 238P1B2 in a biological sample of interest can be compared, for example, to the status of 238P1B2 in a corresponding normal sample (e.g. a sample from that individual or alternatively another individual that is not affected by a pathology). An alteration in the status of 238P1B2 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare 238P1B2 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 238P1B2 expressing cells) as well as the level, and biological activity of expressed gene products (such as 238P1B2 mRNA, polynucleotides and polypeptides). Typically, an alteration in the status of 238P1B2 comprises a change in the location of 238P1B2 and/or 238P1B2 expressing cells and/or an increase in 238P1B2 mRNA and/or protein expression.

238P1B2 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 238P1B2 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 238P1B2 in a biological sample is evaluated by various methods utilized by skilled artisans including, but not limited to genomic Southern analysis (to examine, for example perturbations in a 238P1B2 gene), Northern analysis and/or PCR analysis of 238P1B2 mRNA (to examine, for example alterations in the polynucleotide sequences or expression levels of 238P1B2 mRNAs), and, Western and/or immunohistochemical analysis (to examine, for example alterations in polypeptide sequences, alterations in polypeptide localization within a sample, alterations in expression levels of 238P1B2 proteins and/or associations of 238P1B2 proteins with polypeptide binding partners). Detectable 238P1B2 polynucleotides include, for example, a 238P1B2 gene or fragment thereof, 238P1B2 mRNA, alternative splice variants, 238P1B2 mRNAs, and recombinant DNA or RNA molecules containing a 238P1B2 polynucleotide.

The expression profile of 238P1B2 makes it a diagnostic marker for local and/or metastasized disease, and provides information on the growth or oncogenic potential of a biological sample. In particular, the status of 238P1B2 provides information useful for predicting susceptibility to particular disease stages, progression, and/or tumor aggressiveness. The invention provides methods and assays for determining 238P1B2 status and diagnosing cancers that express 238P1B2, such as cancers of the tissues listed in Table I. For example, because 238P1B2 mRNA is so highly expressed in prostate and other cancers relative to normal prostate tissue, assays that evaluate the levels of 238P1B2 mRNA transcripts or proteins in a biological sample can be used to diagnose a disease associated with 238P1B2 dysregulation, and can provide prognostic information useful in defining appropriate therapeutic options.

The expression status of 238P1B2 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 238P1B2 in biological samples such as those from individuals suffering from, or suspected of suffering from a pathology characterized by dysregulated cellular growth, such as cancer.

As described above, the status of 238P1B2 in a biological sample can be examined by a number of well-known procedures in the art. For example, the status of 238P1B2 in a biological sample taken from a specific location in the body can be examined by evaluating the sample for the presence or absence of 238P1B2 expressing cells (e.g. those that express 238P1B2 mRNAs or proteins). This examination can provide evidence of dysregulated cellular growth, for example, when 238P1B2-expressing cells are found in a biological sample that does not normally contain such cells (such as a lymph node), because such alterations in the status of 238P1B2 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000); Su et al., Semin. Surg. Oncol. 18(1): 17-28 (2000) and Freeman et al., J Urol 1995 August 154(2 Pt 1):474-8).

In one aspect, the invention provides methods for monitoring 238P1B2 gene products by determining the status of 238P1B2 gene products expressed by cells from an individual suspected of having a disease associated with dysregulated cell growth (such as hyperplasia or cancer) and then comparing the status so determined to the status of 238P1B2 gene products in a corresponding normal sample. The presence of aberrant 238P1B2 gene products in the test sample relative to the normal sample provides an indication of the presence of dysregulated cell growth within the cells of the individual.

In another aspect, the invention provides assays useful in determining the presence of cancer in an individual, comprising detecting a significant increase in 238P1B2 mRNA or protein expression in a test cell or tissue sample relative to expression levels in the corresponding normal cell or tissue. The presence of 238P1B2 mRNA can, for example, be evaluated in tissue samples including but not limited to those listed in Table I. The presence of significant 238P1B2 expression in any of these tissues is useful to indicate the emergence, presence and/or severity of a cancer, since the corresponding normal tissues do not express 238P1B2 mRNA or express it at lower levels.

In a related embodiment, 238P1B2 status is determined at the protein level rather than at the nucleic acid level. For example, such a method comprises determining the level of 238P1B2 protein expressed by cells in a test tissue sample and comparing the level so determined to the level of 238P1B2 expressed in a corresponding normal sample. In one embodiment, the presence of 238P1B2 protein is evaluated, for example, using immunohistochemical methods. 238P1B2 antibodies or binding partners capable of detecting 238P1B2 protein expression are used in a variety of assay formats well known in the art for this purpose.

In a further embodiment, one can evaluate the status of 238P1B2 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of 238P1B2 may be indicative of the presence or promotion of a tumor. Such assays therefore have diagnostic and predictive value where a mutation in 238P1B2 indicates a potential loss of function or increase in tumor growth.

A wide variety of assays for observing perturbations in nucleotide and amino acid sequences are well known in the art. For example, the size and structure of nucleic acid or amino acid sequences of 238P1B2 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a 238P1B2 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-1 tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 238P1B2. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 238P1B2 expression. The presence of RT-PCR amplifiable 238P1B2 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment, a method for predicting susceptibility to cancer comprises detecting 238P1B2 mRNA or 238P1B2 protein in a tissue sample, its presence indicating susceptibility to cancer, wherein the degree of 238P1B2 mRNA expression correlates to the degree of susceptibility. In a specific embodiment, the presence of 238P1B2 in prostate or other tissue is examined, with the presence of 238P1B2 in the sample providing an indication of prostate cancer susceptibility (or the emergence or existence of a prostate tumor). Similarly, one can evaluate the integrity 238P1B2 nucleotide and amino acid sequences in a biological sample, in order to identify perturbations in the structure of these molecules such as insertions, deletions, substitutions and the like. The presence of one or more perturbations in 238P1B2 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 238P1B2 mRNA or 238P1B2 protein expressed by tumor cells, comparing the level so determined to the level of 238P1B2 mRNA or 238P1B2 protein expressed in a corresponding normal tissue taken from the same individual or a normal tissue reference sample, wherein the degree of 238P1B2 mRNA or 238P1B2 protein expression in the tumor sample relative to the normal sample indicates the degree of aggressiveness. In a specific embodiment, aggressiveness of a tumor is evaluated by determining the extent to which 238P1B2 is expressed in the tumor cells, with higher expression levels indicating more aggressive tumors. Another embodiment is the evaluation of the integrity of 238P1B2 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 238P1B2 mRNA or 238P1B2 protein expressed by cells in a sample of the tumor, comparing the level so determined to the level of 238P1B2 mRNA or 238P1B2 protein expressed in an equivalent tissue sample taken from the same individual at a different time, wherein the degree of 238P1B2 mRNA or 238P1B2 protein expression in the tumor sample over time provides information on the progression of the cancer. In a specific embodiment, the progression of a cancer is evaluated by determining 238P1B2 expression in the tumor cells over time, where increased expression over time indicates a progression of the cancer. Also, one can evaluate the integrity 238P1B2 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 238P1B2 gene and 238P1B2 gene products (or perturbations in 238P1B2 gene and 238P1B2 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2): 223-9; Thorson et al., 1998, Mod. Pathol. 11(6):543-51; Baisden et al., 1999, Am. J. Surg. Pathol. 23(8):918-24). Methods for observing a coincidence between the expression of 238P1B2 gene and 238P1B2 gene products (or perturbations in 238P1B2 gene and 238P1B2 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 238P1B2 gene and 238P1B2 gene products (or perturbations in 238P1B2 gene and 238P1B2 gene products) and another factor associated with malignancy entails detecting the overexpression of 238P1B2 mRNA or protein in a tissue sample, detecting the overexpression of PSA mRNA or protein in a tissue sample (or PSCA or PSM expression), and observing a coincidence of 238P1B2 mRNA or protein and PSA mRNA or protein overexpression (or PSCA or PSM expression). In a specific embodiment, the expression of 238P1B2 and PSA mRNA in prostate tissue is examined, where the coincidence of 238P1B2 and PSA mRNA overexpression in the sample indicates the existence of prostate cancer, prostate cancer susceptibility or the emergence or status of a prostate tumor.

Methods for detecting and quantifying the expression of 238P1B2 mRNA or protein are described herein, and standard nucleic acid and protein detection and quantification technologies are well known in the art. Standard methods for the detection and quantification of 238P1B2 mRNA include in situ hybridization using labeled 238P1B2 riboprobes, Northern blot and related techniques using 238P1B2 polynucleotide probes, RT-PCR analysis using primers specific for 238P1B2, and other amplification type detection methods, such as, for example, branched DNA, SISBA, TMA and the like. In a specific embodiment, semi-quantitative RT-PCR is used to detect and quantify 238P1B2 mRNA expression. Any number of primers capable of amplifying 238P1B2 can be used for this purpose, including but not limited to the various primer sets specifically described herein. In a specific embodiment, polyclonal or monoclonal antibodies specifically reactive with the wild-type 238P1B2 protein can be used in an immunohistochemical assay of biopsied tissue.

IX.) Identification of Molecules that Interact with 238P1B2

The 238P1B2 protein and nucleic acid sequences disclosed herein allow a skilled artisan to identify proteins, small molecules and other agents that interact with 238P1B2, as well as pathways activated by 238P1B2 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with 238P1B2 protein sequences. In such methods, peptides that bind to 238P1B2 are identified by screening libraries that encode a random or controlled collection of amino acids. Peptides encoded by the libraries are expressed as fusion proteins of bacteriophage coat proteins, the bacteriophage particles are then screened against the 238P1B2 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 238P1B2 protein sequences are disclosed for example in U.S. Pat. No. 5,723,286 issued 3 Mar. 1998 and U.S. Pat. No. 5,733,731 issued 31 Mar. 1998.

Alternatively, cell lines that express 238P1B2 are used to identify protein-protein interactions mediated by 238P1B2. Such interactions can be examined using immunoprecipitation techniques (see, e.g., Hamilton B. J., et al. Biochem. Biophys. Res. Commun. 1999, 261:646-51). 238P1B2 protein can be immunoprecipitated from 238P1B2-expressing cell lines using anti-238P1B2 antibodies. Alternatively, antibodies against His-tag can be used in a cell line engineered to express fusions of 238P1B2 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 238P1B2 can be identified through related embodiments of such screening assays. For example, small molecules can be identified that interfere with protein function, including molecules that interfere with 238P1B2's ability to mediate phosphorylation and de-phosphorylation, interaction with DNA or RNA molecules as an indication of regulation of cell cycles, second messenger signaling or tumorigenesis. Similarly, small molecules that modulate 238P1B2-related ion channel, protein pump, or cell communication functions are identified and used to treat patients that have a cancer that expresses 238P1B2 (see, e.g., Hille, B., Ionic Channels of Excitable Membranes $2^{nd}$ Ed., Sinauer Assoc., Sunderland, Mass., 1992). Moreover, ligands that regulate 238P1B2 function can be identified based on their ability to bind 238P1B2 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 238P1B2 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators which activate or inhibit 238P1B2.

An embodiment of this invention comprises a method of screening for a molecule that interacts with an 238P1B2 amino acid sequence shown in FIG. 2 or FIG. 3, comprising the steps of contacting a population of molecules with a 238P1B2 amino acid sequence, allowing the population of molecules and the 238P1B2 amino acid sequence to interact under conditions that facilitate an interaction, determining the presence of a molecule that interacts with the 238P1B2 amino acid sequence, and then separating molecules that do not interact with the 238P1B2 amino acid sequence from molecules that do. In a specific embodiment, the method further comprises purifying, characterizing and identifying a molecule that interacts with the 238P1B2 amino acid sequence. The identified molecule can be used to modulate a function performed by 238P1B2. In a preferred embodiment, the 238P1B2 amino acid sequence is contacted with a library of peptides.

X.) Therapeutic Methods and Compositions

The identification of 238P1B2 as a protein that is normally expressed in a restricted set of tissues, but which is also expressed in prostate and other cancers, opens a number of therapeutic approaches to the treatment of such cancers. As contemplated herein, 238P1B2 functions as a transcription factor involved in activating tumor-promoting genes or repressing genes that block tumorigenesis.

Accordingly, therapeutic approaches that inhibit the activity of a 238P1B2 protein are useful for patients suffering from a cancer that expresses 238P1B2. These therapeutic approaches generally fall into two classes. One class comprises various methods for inhibiting the binding or association of a 238P1B2 protein with its binding partner or with other proteins. Another class comprises a variety of methods for inhibiting the transcription of a 238P1B2 gene or translation of 238P1B2 mRNA.

X.A.) Anti-Cancer Vaccines

The invention provides cancer vaccines comprising a 238P1B2-related protein or 238P1B2-related nucleic acid. In view of the expression of 238P1B2, cancer vaccines prevent and/or treat 238P1B2-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a 238P1B2-related protein, or an 238P1B2-encoding nucleic acid molecule and recombinant vectors capable of expressing and presenting the 238P1B2 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 February 31(1):66-78; Maruyama et al., Cancer Immunol Immunother 2000 June 49(3):123-32) Briefly, such methods of generating an immune response (e.g. humoral and/or cell-mediated) in a mammal, comprise the steps of: exposing the mammal's immune system to an immunoreactive epitope (e.g. an epitope present in a 238P1B2 protein shown in FIG. 3 or analog or homolog thereof) so that the mammal generates an immune response that is specific for that epitope (e.g. generates antibodies that specifically recognize that epitope). In a preferred method, a 238P1B2 immunogen contains a biological motif, see e.g., Tables V-XVIII, Table XIX, or a peptide of a size range from 238P1B2 indicated in FIG. 5, FIG. 6, FIG. 7, FIG. 8, and FIG. 9.

The entire 238P1B2 protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods*. 192:25, 1996; Eldridge, J. H. et al., *Sem. Hematol.* 30:16, 1993; Falo, L. D., Jr. et al., *Nature Med* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

In patients with 238P1B2-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 238P1B2 protein that bind corresponding HLA alleles (see e.g., Table IV; Epimemm and Epimatrix™, Brown University; and, BIMAS, and SYFPEITHI). In a preferred embodiment, a 238P1B2 immunogen contains one or more amino acid sequences identified using techniques well known in the art, such as the sequences shown in Tables V-XVIII, Table XIX, or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 238P1B2 protein) so that an immune response is generated. A typical embodiment consists of a method for generating an immune response to 238P1B2 in a host, by contacting the host with a sufficient amount of at least one 238P1B2 B cell or cytotoxic T-cell epitope or analog thereof; and at least one periodic interval thereafter re-contacting the host with the 238P1B2 B cell or cytotoxic T-cell epitope or analog thereof. A specific embodiment consists of a method of generating an immune response against a 238P1B2-related protein or a man-made multiepitopic peptide comprising: administering 238P1B2 immunogen (e.g. a 238P1B2 protein or a peptide fragment thereof, an 238P1B2 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al, J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a 238P1B2 immunogen by: administering in vivo to muscle or skin of the individual's body a DNA molecule that comprises a DNA sequence that encodes an 238P1B2 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 238P1B2, in order to generate a response to the target antigen.

Nucleic Acid Vaccines:

Vaccine compositions of the invention include nucleic acid-mediated modalities. DNA or RNA that encode protein (s) of the invention can be administered to a patient. Genetic immunization methods can be employed to generate prophylactic or therapeutic humoral and cellular immune responses directed against cancer cells expressing 238P1B2. Constructs comprising DNA encoding a 238P1B2-related protein/immunogen and appropriate regulatory sequences can be injected directly into muscle or skin of an individual, such that the cells of the muscle or skin take-up the construct and express the encoded 238P1B2 protein/immunogen. Alternatively, a vaccine comprises a 238P1B2-related protein. Expression of the 238P1B2-related protein immunogen results in the generation of prophylactic or therapeutic humoral and cellular immunity against cells that bear a 238P1B2 protein. Various prophylactic and therapeutic genetic immunization techniques known in the art can be used (for review, see information and references published at the world wide web Internet address genweb.com). Nucleic acid-based delivery is described, for instance, in Wolff et. al., Science 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. *J. Natl. Cancer Inst.* 87:982-990 (1995)). Non-viral delivery systems can also be employed by introducing naked DNA encoding a 238P1B2-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Thus, gene delivery systems are used to deliver a 238P1B2-related nucleic acid molecule. In one embodiment, the full-length human 238P1B2 cDNA is employed. In another embodiment, 238P1B2 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendritic cells (DC) to present 238P1B2 antigen to a patient's immune system. Dendritic cells express MHC class I and II molecules, B7 co-stimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present 238P1B2 peptides to T cells in the context of MHC class I or II molecules. In one embodiment, autologous dendritic cells are pulsed with 238P1B2 peptides capable of binding to MHC class I and/or class II molecules. In another embodiment, dendritic cells are pulsed with the complete 238P1B2 protein. Yet another embodiment involves engineering the overexpression of a 238P1B2 gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186: 1177-1182). Cells that express 238P1B2 can also be engineered to express immune modulators, such as GM-CSF, and used as immunizing agents.

X.B.) 238P1B2 as a Target for Antibody-based Therapy

238P1B2 is an attractive target for antibody-based therapeutic strategies. A number of antibody strategies are known in the art for targeting both extracellular and intracellular molecules (see, e.g., complement and ADCC mediated killing as well as the use of intrabodies). Because 238P1B2 is expressed by cancer cells of various lineages relative to corresponding normal cells, systemic administration of 238P1B2-immunoreactive compositions are prepared that exhibit excellent sensitivity without toxic, non-specific and/or non-target effects caused by binding of the immunoreactive composition to non-target organs and tissues. Antibodies specifically reactive with domains of 238P1B2 are useful to treat 238P1B2-expressing cancers systemically, either as conjugates with a toxin or therapeutic agent, or as naked antibodies capable of inhibiting cell proliferation or function.

238P1B2 antibodies can be introduced into a patient such that the antibody binds to 238P1B2 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 238P1B2, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 238P1B2 sequence shown in FIG. 2 or FIG. 3. In addition, skilled artisans understand that it is routine to conjugate antibodies to cytotoxic agents (see, e.g., Slevers et al *Blood* 93:11 3678-3684 (Jun. 1, 1999)). When cytotoxic and/or therapeutic agents are delivered directly to cells, such as by conjugating them to antibodies specific for a molecule expressed by that cell (e.g. 238P1B2), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-238P1B2 antibody) that binds to a marker (e.g. 238P1B2) expressed, accessible to binding or localized on the cell surfaces. A typical embodiment is a method of delivering a cytotoxic and/or therapeutic agent to a cell expressing 238P1B2, comprising conjugating the cytotoxic agent to an antibody that immunospecifically binds to a 238P1B2 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-238P1B2 antibodies can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor Immunol. 19:93-101), leukemia (Zhong et al., 1996, Leuk. Res. 20:581-589), colorectal cancer (Moun et al, 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 238P1B2 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 238P1B2 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637-4642, 1993), Prewett et al. (International J. of Onco. 9:217-224, 1996), and Hancock et al. (Cancer Res. 51:4575-4580, 1991) describe the use of various antibodies together with chemotherapeutic agents.

Although 238P1B2 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 238P1B2 expression, preferably using immunohistochemical assessments of tumor tissue, quantitative 238P1B2 imaging, or other techniques that reliably indicate the presence and degree of 238P1B2 expression. Immunohistochemical analysis of tumor biopsies or surgical specimens is preferred for this purpose. Methods for immunohistochemical analysis of tumor tissues are well known in the art.

Anti-238P1B2 monoclonal antibodies that treat prostate and other cancers include those that initiate a potent immune response against the tumor or those that are directly cytotoxic. In this regard, anti-238P1B2 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-238P1B2 mAbs that exert a direct biological effect on tumor growth are useful to treat cancers that express 238P1B2. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-238P1B2 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 238P1B2 antigen with high affinity but exhibit low or no antigenicity in the patient.

Therapeutic methods of the invention contemplate the administration of single anti-238P1B2 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-238P1B2 mAbs can be administered concomitantly with other therapeutic modalities, including but not limited to various chemotherapeutic agents, androgen-blockers, immune modulators (e.g., IL-2, GM-CSF), surgery or radiation. The anti-238P1B2 mAbs are administered in their "naked" or unconjugated form, or can have a therapeutic agent(s) conjugated to them.

Anti-238P1B2 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-238P1B2 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-238P1B2 mAb preparation represents an acceptable dosing regimen. Preferably, the initial loading dose is administered as a 90 minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 238P1B2 expression in the patient, the extent of circulating shed 238P1B2 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 238P1B2 in a given sample (e.g. the levels of circulating 238P1B2 antigen and/or 238P1B2 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-238P1B2 antibodies can also be used in anti-cancer therapy as a vaccine for inducing an immune response to cells expressing a 238P1B2-related protein. In particular, the generation of anti-idiotypic antibodies is well known in the art; this methodology can readily be adapted to generate anti-idiotypic anti-238P1B2 antibodies that mimic an epitope on a 238P1B2-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) 238P1B2 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis *J. Immunol.* 165:539-547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 238P1B2 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142). A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., *Science* 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif- and/or motif-bearing epitopes derived 238P1B2, the PADRE® universal helper T cell epitope (or multiple HTL epitopes from 238P1B2), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an E. coli origin of replication; and an E. coli selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate E. coli strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in E. coli, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, BioTechniques 6(7): 682 (1988); U.S. Pat. No. 5,279,833; WO 91/06309; and Feigner, et al., Proc. Nat'l Acad. Sci. USA 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No.

5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 (QYIKANSKFIGITE; SEQ ID: 1), *Plasmodium falciparum* circumsporozoite (CS) protein at positions 378-398 (DIEKKIAKMEKASSVFNV-VNS; SEQ ID: 2), and *Streptococcus* 18 kD protein at positions 116-131 (GAVDSILGGVATYGAA; SEQ ID: 3). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferably bind most HLA-DR (human HLA class II) molecules. For instance, a pan-DR-binding epitope peptide having the formula: aKXVAAWTLKAAa (SEQ ID: 4), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the $\epsilon$- and $\alpha$-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to $\epsilon$- and $\alpha$-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinyl-seryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to specifically prime an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 238P1B2. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 238P1B2.

X.D. Adoptive Immunotherapy

Antigenic 238P1B2-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 238P1B2. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 238P1B2. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 238P1B2-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 238P1B2, a vaccine comprising 238P1B2-specific CTL may be more efficacious in killing tumor cells in patient with advanced disease than alternative embodiments.

It is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μg to about 50,000 μg per 70 kilogram patient. Boosting dosages of between about 1.0 μg to about 50,000 μg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 μg and the higher value is about 10,000; 20,000; 30,000; or 50,000 μg.

Dosage values for a human typically range from about 500 μg to about 50,000 μg per 70 kilogram patient. This is followed by boosting dosages of between about 1.0 μg to about 50,000 μg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., *Remington's Pharmaceutical Sciences*, 17$^{th}$ Edition, A. Gennaro, Editor, Mack Publishing Co., Easton, Pa., 1985). For example a peptide dose for initial immunization can be from about 1 to about 50,000 μg, generally 100-5,000 μg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 μg) can also be administered using a gene gun. Following an incubation period of 3-4 weeks, a booster dose is then administered. The booster can be recombinant fowlpox virus administered at a dose of 5-10$^7$ to 5×10$^9$ pfu.

For antibodies, a treatment generally involves repeated administration of the anti-238P1B2 antibody preparation, via an acceptable route of administration such as intravenous injection (IV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-238P1B2 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 238P1B2 expression in the patient, the extent of circulating shed 238P1B2 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 μg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg m$^2$ of body area weekly; 1-600 mg m$^2$ of body area weekly; 225-400 mg m$^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about 10$^4$ cells to about 10$^6$ cells, about 10$^6$ cells to about 10$^8$ cells, about 10$^8$ to about 10$^{11}$ cells, or about 10$^8$ to about 5×10$^{10}$ cells. A dose may also about 10$^6$ cells/m$^2$ to about 10$^{10}$ cells/m$^2$, or about 10$^6$ cells/m$^2$ to about 10$^8$ cells/m$^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng.* 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) Diagnostic and Prognostic Embodiments of 238P1B2.

As disclosed herein, 238P1B2 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in Example 4).

238P1B2 can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. August; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 July 4(1):99-102 and Minimoto et al., Cancer Detect Prev 2000; 24(1):1-12). Therefore, this disclosure of 238P1B2 polynucleotides and polypeptides (as well as 238P1B2 polynucleotide probes and anti-238P1B2 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 238P1B2 polynucleotides, polypeptides, reactive T cells and antibodies are analogous to those methods from well-established diagnostic assays which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the 238P1B2 polynucleotides described herein can be utilized in the same way to detect 238P1B2 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the 238P1B2 polypeptides described herein can be utilized to generate antibodies for use in detecting 238P1B2 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 238P1B2 polynucleotides and/or polypeptides can be used to provide evidence of metastasis. For example, when a biological sample from tissue that does not normally contain 238P1B2-expressing cells (lymph node) is found to contain 238P1B2-expressing cells such as the 238P1B2 expression seen in LAPC4 and LAPC9, xenografts isolated from lymph node and bone metastasis, respectively, this finding is indicative of metastasis.

Alternatively 238P1B2 polynucleotides and/or polypeptides can be used to provide evidence of cancer, for example, when cells in a biological sample that do not normally express 238P1B2 or express 238P1B2 at a different level are found to express 238P1B2 or have an increased expression of 238P1B2 (see, e.g., the 238P1B2 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 238P1B2) such as PSA, PSCA etc. (see, e.g., Alanen et al., Pathol. Res. Pract. 192(3): 233-237 (1996)).

Just as PSA polynucleotide fragments and polynucleotide variants are employed by skilled artisans for use in methods of monitoring PSA, 238P1B2 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al., Methods Mol. Biol. 98:121-154 (1998)). An additional illustration of the use of such fragments is provided in Example 4, where a 238P1B2 polynucleotide fragment is used as a probe to show the expression of 238P1B2 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 Nov.-Dec. 11(6):407-13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a 238P1B2 polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 238P1B2 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 238P1B2 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 238P1B2 polypeptide shown in FIG. 3).

As shown herein, the 238P1B2 polynucleotides and polypeptides (as well as the 238P1B2 polynucleotide probes and anti-238P1B2 antibodies or T cells used to identify the presence of these molecules) exhibit specific properties that make them useful in diagnosing cancers such as those listed in Table I. Diagnostic assays that measure the presence of 238P1B2 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as 238P1B2 polynucleotides and polypeptides (as well as the 238P1B2 polynucleotide probes and anti-238P1B2 antibodies used to identify the presence of these molecules) need to be employed to confirm a metastases of prostatic origin.

Finally, in addition to their use in diagnostic assays, the 238P1B2 polynucleotides disclosed herein have a number of other utilities such as their use in the identification of oncogenetic associated chromosomal abnormalities in the chromosomal region to which the 238P1B2 gene maps (see Example 3 below). Moreover, in addition to their use in diagnostic assays, the 238P1B2-related proteins and polynucleotides disclosed herein have other utilities such as their use in the forensic analysis of tissues of unknown origin (see, e.g., Takahama K Forensic Sci Int 1996 Jun. 28; 80(1-2): 63-9).

Additionally, 238P1B2-related proteins or polynucleotides of the invention can be used to treat a pathologic condition characterized by the over-expression of 238P1B2. For example, the amino acid or nucleic acid sequence of FIG. 2 or FIG. 3, or fragments of either, can be used to generate an immune response to a 238P1B2 antigen. Antibodies or other molecules that react with 238P1B2 can be used to modulate the function of this molecule, and thereby provide a therapeutic benefit.

XII.) Inhibition of 238P1B2 Protein Function

The invention includes various methods and compositions for inhibiting the binding of 238P1B2 to its binding partner or its association with other protein(s) as well as methods for inhibiting 238P1B2 function.

XII.A.) Inhibition of 238P1B2 with Intracellular Antibodies

In one approach, a recombinant vector that encodes single chain antibodies that specifically bind to 238P1B2 are introduced into 238P1B2 expressing cells via gene transfer technologies. Accordingly, the encoded single chain anti-238P1B2 antibody is expressed intracellularly, binds to 238P1B2 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to precisely target the intrabody to the desired intracellular compartment. For example, intrabodies targeted to the endoplasmic reticulum (ER) are engineered to incorporate a leader peptide and, optionally, a C-terminal ER retention signal, such as the KDEL (SEQ ID: 5) amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 238P1B2 in the nucleus, thereby preventing its activity within the nucleus. Nuclear targeting signals are engineered into such 238P1B2 intrabodies in order to achieve the desired targeting. Such 238P1B2 intrabodies are designed to bind specifically to a particular 238P1B2 domain. In another embodiment, cytosolic intrabodies that specifically bind to a 238P1B2 protein are used to prevent 238P1B2 from gaining access to the nucleus, thereby preventing it from exerting any biological activity within the nucleus (e.g., preventing 238P1B2 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 238P1B2 with Recombinant Proteins

In another approach, recombinant molecules bind to 238P1B2 and thereby inhibit 238P1B2 function. For example, these recombinant molecules prevent or inhibit 238P1B2 from accessing/binding to its binding partner(s) or associating with other protein(s). Such recombinant molecules can, for example, contain the reactive part(s) of a 238P1B2 specific antibody molecule. In a particular embodiment, the 238P1B2 binding domain of a 238P1B2 binding partner is engineered into a dimeric fusion protein, whereby the fusion protein comprises two 238P1B2 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of 238P1B2, whereby the dimeric fusion protein specifically binds to 238P1B2 and blocks 238P1B2 interaction with a binding partner. Such dimeric fusion proteins are further combined into multimeric proteins using known antibody linking technologies.

XII.C.) Inhibition of 238P1B2 Transcription or Translation

The present invention also comprises various methods and compositions for inhibiting the transcription of the 238P1B2 gene. Similarly, the invention also provides methods and compositions for inhibiting the translation of 238P1B2 mRNA into protein.

In one approach, a method of inhibiting the transcription of the 238P1B2 gene comprises contacting the 238P1B2 gene with a 238P1B2 antisense polynucleotide. In another approach, a method of inhibiting 238P1B2 mRNA translation comprises contacting a 238P1B2 mRNA with an antisense polynucleotide. In another approach, a 238P1B2 specific ribozyme is used to cleave a 238P1B2 message, thereby inhibiting translation. Such antisense and ribozyme based methods can also be directed to the regulatory regions of the 238P1B2 gene, such as 238P1B2 promoter and/or enhancer elements. Similarly, proteins capable of inhibiting a 238P1B2 gene transcription factor are used to inhibit 238P1B2 mRNA transcription. The various polynucleotides and compositions useful in the aforementioned methods have been described above. The use of antisense and ribozyme molecules to inhibit transcription and translation is well known in the art.

Other factors that inhibit the transcription of 238P1B2 by interfering with 238P1B2 transcriptional activation are also useful to treat cancers expressing 238P1B2. Similarly, factors that interfere with 238P1B2 processing are useful to treat cancers that express 238P1B2. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 238P1B2 (i.e., antisense, ribozyme, polynucleotides encoding intrabodies and other 238P1B2 inhibitory molecules). A number of gene therapy approaches are known in the art. Recombinant vectors encoding 238P1B2 antisense polynucleotides, ribozymes, factors capable of interfering with 238P1B2 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 238P1B2 to a binding partner, etc.

In vivo, the effect of a 238P1B2 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Kits

For use in the diagnostic and therapeutic applications described herein, kits are also within the scope of the invention. Such kits can comprise a carrier, package or container that is compartmentalized to receive one or more containers such as vials, tubes, and the like, each of the container(s) comprising one of the separate elements to be used in the method. For example, the container(s) can comprise a probe that is or can be detectably labeled. Such probe can be an antibody or polynucleotide specific for a 238P1B2-related protein or a 238P1B2 gene or message, respectively. Where the method utilizes nucleic acid hybridization to detect the target nucleic acid, the kit can also have containers containing nucleotide(s) for amplification of the target nucleic acid sequence and/or a container comprising a reporter-means, such as a biotin-binding protein, such as avidin or streptavidin, bound to a reporter molecule, such as an enzymatic, florescent, or radioisotope label. The kit can include all or part of the amino acid sequence of FIG. 2 or FIG. 3 or analogs thereof, or a nucleic acid molecules that encodes such amino acid sequences.

The kit of the invention will typically comprise the container described above and one or more other containers comprising materials desirable from a commercial and user standpoint, including buffers, diluents, filters, needles, syringes, and package inserts with instructions for use.

A label can be present on the container to indicate that the composition is used for a specific therapy or non-therapeutic application, and can also indicate directions for either in vivo or in vitro use, such as those described above. Directions and or other information can also be included on an insert which is included with the kit.

EXAMPLES

Various aspects of the invention are further described and illustrated by way of the several examples that follow, none of which are intended to limit the scope of the invention.

Example 1

SSH-Generated Isolation of a cDNA Fragment of the 238P1B2 Gene

The Suppression Subtractive Hybridization (SSH) procedure using cDNA derived from patient cancer tissues is used to isolate genes that are over-expressed in cancer. The 238P1B2 SSH cDNA sequence was derived from a colon cancer pool minus normal tissue cDNA subtraction. Included in the driver were cDNAs derived from 10 normal tissues. The 238P1B2 cDNA was identified as highly expressed in the prostate cancer tissue pool, with restricted expression detected in normal tissues.

The SSH DNA sequence of 210 bp (FIG. 1) is novel but shows homology to mouse olfactory receptor MOR14-10 mRNA. A 238P1B2 cDNA, 238P1B2-clone A, of 3754 bp was isolated from prostate cDNA library, revealing an ORF of 254 amino acids (FIG. 2, FIG. 3 and FIG. 4A).

Materials and Methods

Human Tissues:

The patient cancer and normal tissues were purchased from different sources such as the NDRI (Philadelphia, Pa.). mRNA for some normal tissues were purchased from Clontech, Palo Alto, Calif.

RNA Isolation:

Tissues were homogenized in Trizol reagent (Life Technologies, Gibco BRL) using 10 ml/g tissue isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

```
DPNCDN (cDNA synthesis primer):
                                          (SEQ ID: 6)
5'TTTTGATCAAGCTT₃₀3'

Adaptor 1:
                                          (SEQ ID: 7)
5'CTAATACGACTCACTATAGGGCTCGAGCGGCCGCCCGGGCAG3'

(SEQ ID: 8)
3'GGCCCGTCCTAG5'

Adaptor 2:
                                          (SEQ ID: 9)
5'GTAATACGACTCACTATAGGGCAGCGTGGTCGCGGCCGAG3'

(SEQ ID: 10)
3'CGGCTCCTAG5'

PCR primer 1:
                                          (SEQ ID: 11)
5'CTAATACGACTCACTATAGGGC3'

Nested primer (NP)1:
                                          (SEQ ID: 12)
5'TCGAGCGGCCGCCCGGGCAGGA3'

Nested primer (NP)2:
                                          (SEQ ID: 13)
5'AGCGTGGTCGCGGCCGAGGA3'
```

Suppression Subtractive Hybridization:

Suppression Subtractive Hybridization (SSH) was used to identify cDNAs corresponding to genes that are differentially expressed in cancer. The SSH reaction utilized cDNA from colon cancer and normal tissues.

The gene 238P1B2 sequence was derived from a colon cancer pool minus normal tissue cDNA subtraction. The SSH DNA sequence (FIG. 1) was identified.

The cDNA derived from of a pool of normal tissues was used as the source of the "driver" cDNA, while the cDNA from a pool of patient cancer tissues was used as the source of the "tester" cDNA. Double stranded cDNAs corresponding to tester and driver cDNAs were synthesized from 2 μg of poly (A)⁺ RNA isolated from the relevant xenograft tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Driver cDNA was generated by combining in a 1:1 ratio Dpn II digested cDNA from the relevant tissue source (see above) with a mix of digested cDNAs derived from the nine normal tissues: stomach, skeletal muscle, lung, brain, liver, kidney, pancreas, small intestine, and heart.

Tester cDNA was generated by diluting 1 μl of Dpn II digested cDNA from the relevant tissue source (see above) (400 ng) in 5 μl of water. The diluted cDNA (2 μl, 160 ng) was then ligated to 2 μl of Adaptor 1 and Adaptor 2 (10 μM), in separate ligation reactions, in a total volume of 10 μl at 16° C. overnight, using 400 u of T4 DNA ligase (CLONTECH). Ligation was terminated with 1 μl of 0.2 M EDTA and heating at 72° C. for 5 min.

The first hybridization was performed by adding 1.5 μl (600 ng) of driver cDNA to each of two tubes containing 1.5 μl (20 ng) Adaptor 1- and Adaptor 2-ligated tester cDNA. In a final volume of 4 μl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 μl of fresh denatured driver cDNA and were allowed to hybridize overnight at 68° C. The second hybridization was then diluted in 200 μl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 μl of the diluted final hybridization mix was added to 1 μl of PCR primer I (10 μM), 0.5 μl dNTP mix (10 μM), 2.5 μl 10× reaction buffer (CLONTECH) and 0.5 μl 50× Advantage cDNA polymerase Mix (CLONTECH) in a final volume of 25 μl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 μl from the pooled and diluted primary PCR reaction was added to the same reaction mix as used for PCR 1, except that primers NP1 and NP2 (10 μM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed E. coli were subjected to blue/white and ampicillin selection. White colonies were picked and arrayed into 96 well plates and were grown in liquid culture overnight. To identify inserts, PCR amplification was performed on 1 ml of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 μg of mRNA with oligo (dT)12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 μl with water prior to normalization. First strand cDNAs from 16 different normal human tissues can be obtained from Clontech.

Normalization of the first strand cDNAs from multiple tissues was performed by using the primers 5'atatcgc-cgcgctcgtcgtcgacaa3' (SEQ ID: 14) and 5'agccacacgcagctcat-tgtagaagg 3' (SEQ ID: 15) to amplify β-actin. First strand cDNA (5 μl) were amplified in a total volume of 50 μl containing 0.4 μM primers, 0.2 μM each dNTPs, 1×PCR buffer (Clontech, 10 mM Tris-HCL, 1.5 mM MgCl$_2$, 50 mM KCl, pH8.3) and 1× Klentaq DNA polymerase (Clontech). Five μl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 b.p. β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 238P1B2 gene, 5 μl of normalized first strand cDNA were analyzed by PCR using 26, and 30 cycles of amplification. Semi-quantitative expression analysis can be achieved by comparing the PCR products at cycle numbers that give light band intensities. The primers used for RT-PCR were designed using the 238P1B2 SSH sequence and are listed below:

```
238P1B2.1
5'- TTGCAGAATATCACCTCCACTTCC -3'    (SEQ ID: 16)

238P1B2.2
5'- GATCAGGCTGTTTCCCAAGAGAG -3'     (SEQ ID: 17)
```

A typical RT-PCR expression analysis is shown in FIG. 14. RT-PCR expression analysis was performed on first strand cDNAs generated using pools of tissues from multiple samples. The cDNAs were shown to be normalized using beta-actin PCR. Results show strong expression of 238P1B2 in prostate cancer pool but not in vital pool 1 and vital pool 2.

Example 2

Full Length Cloning of 238P1B2

The 238P1B2 SSH cDNA sequence was derived from a colon cancer pool minus normal tissue cDNA subtraction. The SSH cDNA sequence (FIG. 1) was designated 238P1B2.

The SSH DNA sequence of 210 bp (FIG. 1) is novel and shows 91% identity to mouse olfactory receptor MOR14-10 mRNA.

A full length cDNA (238P1B2-clone A) of 3754 bp was isolated from prostate library, revealing an ORF of 254 amino acids (FIGS. 2 and 3). The cDNA shows highest homology to the mouse MOR-14-1 and MOR14-10 olfactory receptors, with identities of 85% over 912 nucleotides and 83% over 906 nucleotides respectively (FIG. 4).

The protein sequence reveals 7 transmembrane domains and has homology to G protein-coupled receptors (GPCRs) involved in olfaction (Raming et al., 1993, Nature 361: 353; Malnic et al., 1999, Cell 96:713). Proteins that are members of this receptor family exhibit an extracellular amino-terminus, three additional extracellular loops, three intracellular loops and an intracellular carboxyl terminus.

The most homologous sequence to 238P1B2 is mouse MOR14-1 protein. The two proteins share 83% identity over a 253 amino acid region. Alignment of the two proteins is shown in FIG. 4.

238P1B2 also shows significant homology to the prostate specific GPCR, PHOR-1. The two proteins share 48% identity over a region of 250 amino acids (FIG. 4).

The full length 238P1B2 cDNA (238P1B2-clone A) was deposited with the American Type Culture Collection on Mar. 7, 2002, and assigned accession number PTA-4124.

238P1B2 v.1A protein sequence codes for a six transmembrane protein. Extension of the protein at the amino terminus adds another 62 amino acids to 238P1B2 v.1A leading to 238P1B2 v.1B. This 62 amino acid terminus of 238P1B2 v.1B encodes an additional transmembrane region, and thereby making 238P1B2 v.1B a seven transmembrane protein. Furthermore, this amino terminus shows 84% identity to the mouse MOR14-10 G-coupled protein receptor, indicating that this amino-terminal portion is encoded in nature.

The natural expression of 238P1B2 v.1B can occur if the stop site upstream of the 62 amino acid extension is modified by single nucleic acid substitution leading to conversion of the stop codon into a coding amino acid. Polymorphisms can exist within different tissues, or between different individuals that mutate the stop codon, and therefore allowing proper translation of the 62 amino acid amino-terminal region of 238P1B2 v.1B. Such a variation can either add a start methionine directly, or extend the coding region 238P1B2 v.1B for an additional 16 amino acids until reaching a start methionine at nucleic acid position 1896.

Example 3

Chromosomal Mapping of 238P1B2 Gene

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Alabama), human-rodent somatic cell hybrid panels such as is available from the Coriell Institute (Camden, N.J.), and genomic viewers utilizing BLAST homologies to sequenced and mapped genomic clones (NCBI, Bethesda, Md.).

Using 238P1B2 sequence and the NCBI BLAST tool, placed 238P1B2 to chromosome 11p15.5, a region rich in GPCRs.

Because the human 238P1B2 gene maps to chromosome 11p15.5, polynucleotides encoding different regions of the 238P1B2 protein can be used to characterize cytogenetic abnormalities on chromosome 11, band p15.5 that have been identified as being associated with various cancers. In particular, a variety of chromosomal abnormalities in 11p15.5 have been identified as frequent cytogenetic abnormalities in a number of different cancers (see, e.g., Lai et al., 2000, Clin. Cancer Res. 6(8):3172-6; Oya and Schulz, 2000, Br. J. Cancer 83(5):626-31; Svaren et al., Sep. 12, 2000, J. Biol. Chem.). Consequently, polynucleotides encoding specific regions of the 238P1B2 protein provide new tools that can be used to delineate, with greater precision than previously possible, the specific nature of the cytogenetic abnormalities in this region of chromosome 11 that contribute to the malignant phenotype. In this context, these polynucleotides satisfy a need in the art for expanding the sensitivity of chromosomal screening in order to identify more subtle and less common chromosomal abnormalities (see, e.g., Evans et al., 1994, Am. J. Obstet. Gynecol. 171(4):1055-1057).

Example 4

Expression Analysis of 238P1B2 in Normal Tissues and Patient Specimens

Expression analysis by RT-PCR demonstrated that 238P1B2 is strongly expressed in prostate cancer patient specimens (FIG. 14). First strand cDNA was prepared from vital pool 1 (liver, lung and kidney), vital pool 2 (pancreas, colon and stomach) and prostate cancer pool. Normalization was performed by PCR using primers to actin and GAPDH. Semi-quantitative PCR, using primers to 238P1B2, was performed at 26 and 30 cycles of amplification. Results show strong expression of 238P1B2 in prostate cancer pool but not in vital pool 1 and vital pool 2.

Northern blot analysis of 238P1B2 in 16 human normal tissues is shown in FIG. 15. Results show absence of 238P1B2 expression in all 16 normal tissues tested. Extensive analysis of expression of 238P1B2 in 76 human tissues shows restricted expression of 238P1B2 in placenta (FIG. 16).

Expression of 238P1B2 in patient cancer specimens and human normal tissues is shown in FIG. 17. RNA was extracted from a pool of three prostate cancers, as well as from normal prostate (NP), normal bladder (NB), normal kidney (NK), normal colon (NC), normal lung (NL) normal breast (NBr) and normal ovary (NO). Northern blot with 10 μg of total RNA/lane was probed with 238P1B2 sequence. The results show expression of an approximately 4.5 kb 238P1B2 transcript in the prostate cancer pool and ovary but not in the other normal tissues tested. Analysis of individual patient specimens shows strong expression of 238P1B2 in prostate cancer tissues (FIG. 18). The expression for 238P1B2 detected in tumors of Gleason score 7 is significantly stronger than the expression detected in tumors of Gleason score 5. This result indicates that 238P1B2 can be used as a prognostic marker for prostate cancer.

The restricted expression of 238P1B2 in normal tissues and the expression detected in prostate cancer suggest that 238P1B2 is a potential therapeutic target and a diagnostic marker for human cancers.

Example 5

Transcript Variants of 238P1B2

Transcript variants are variants of mature mRNA from the same gene by alternative transcription or alternative splicing. Alternative transcripts are transcripts from the same gene that start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or can encode proteins with different functions, and can be expressed in the same tissue at the same time, or in different tissues at the same time, or in the same tissue at different times, or in different tissues at different times. Proteins encoded by transcript variants can have similar or different cellular or extracellular localizations, e.g., secreted versus intracellular.

Transcript variants are identified by a variety of art-accepted methods. For example, alternative transcripts and splice variants are identified by full-length cloning experiments, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April; 10(4):516-22); Grail and GenScan. For a general discussion of splice variant identification protocols see., e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl. Acad Sci USA. 2000 Nov. 7; 97(23):12690-3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1-2): 321-6; Ferranti P, et al., Differential splicing of pre-messenger RNA produces multiple forms of mature caprine alpha(s1)-casein, Eur J. Biochem. 1997 Oct. 1; 249(1):1-7. For PCR-based Validation: Wellmann S, et al., Specific reverse transcription-PCR quantification of vascular endothelial growth factor (VEGF) splice variants by LightCycler technology, Clin Chem. 2001 April; 47(4):654-60; Jia, H. P., et al., Discovery of new human beta-defensins using a genomics-based approach, Gene. 2001 Jan. 24; 263(1-2): 211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which a gene maps is modulated in a particular cancer, the alternative transcripts or splice variants of the gene are modulated as well. Disclosed herein is that 238P1B2 has a particular expression profile. Alternative transcripts and splice variants of 238P1B2 can share this expression pattern, thus serving as tumor-associated markers/antigens.

The exon composition of the original transcript, designated as 238P1B2 v.1, is shown in Table XXIII. No transcript variant has been identified by the above methods.

Example 6

Single Nucleotide Polymorphisms of 238P1B2

A Single Nucleotide Polymorphism (SNP) is a single base pair variation in a nucleotide sequence at a specific location. At any given point of the genome, there are four possible nucleotide base pairs: A/T, C/G, G/C and T/A. Genotype refers to the specific base pair sequence of one or more locations in the genome of an individual. Haplotype refers to the base pair sequence of more than one location on the same DNA molecule (or the same chromosome in higher organisms), often in the context of one gene or in the context of several tightly linked genes. SNPs that occur on a cDNA are called cSNPs. These cSNPs may change amino acids of the protein encoded by the gene and thus change the functions of the protein. Some SNPs cause inherited diseases; others contribute to quantitative variations in phenotype and reactions to environmental factors including diet and drugs among individuals. Therefore, SNPs and/or combinations of alleles (called haplotypes) have many applications, including diagnosis of inherited diseases, determination of drug reactions and dosage, identification of genes responsible for diseases, and analysis of the genetic relationship between individuals (P. Nowotny, J. M. Kwon and A. M. Goate, "SNP analysis to dissect human traits," Curr. Opin. Neurobiol. 2001 October; 11(5):637-641; M. Pirmohamed and B. K. Park, "Genetic susceptibility to adverse drug reactions," Trends Pharmacol. Sci. 2001 June; 22(6):298-305; J. H. Riley, C. J. Allan, E. Lai and A. Roses, "The use of single nucleotide polymorphisms in the isolation of common disease genes," Pharmacogenomics. 2000 February; 1(1):39-47; R. Judson, J. C. Stephens and A. Windemuth, "The predictive power of haplotypes in clinical response," Pharmacogenomics. 2000 February; 1(1): 15-26).

SNPs are identified by a variety of art-accepted methods (P. Bean, "The promising voyage of SNP target discovery," Am. Clin. Lab. 2001 October-November; 20(9):18-20; K. M. Weiss, "In search of human variation," Genome Res. 1998 July; 8(7):691-697; M. M. She, "Enabling large-scale pharmacogenetic studies by high-throughput mutation detection and genotyping technologies," Clin. Chem. 2001 February; 47(2):164-172). For example, SNPs are identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled from different individuals or by comparing sequences from different DNA samples. With the rapid accumulation of sequence data in public and private databases, one can discover SNPs by comparing sequences using computer programs (Z. Gu, L. Hillier and P. Y. Kwok, "Single nucleotide polymorphism hunting in cyberspace," Hum. Mutat. 1998; 12(4):221-225). SNPs can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235-258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329-340).

Figure 10:
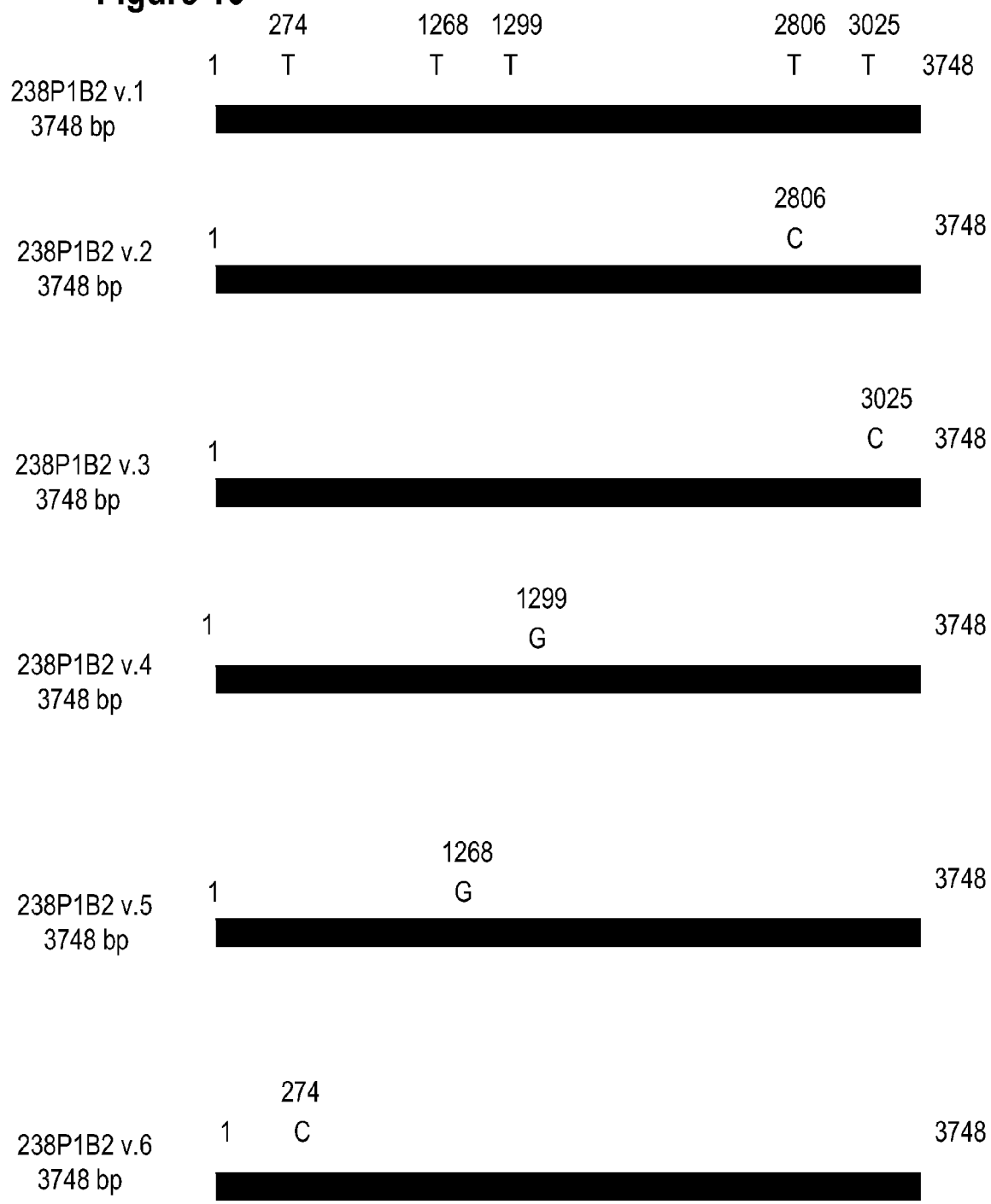
FIG. 10. Schematic display of nucleotide variants of 238P1B2. Variant 238P1B2 v.2 through 238P1B2 v.6 are variants with single nucleotide variations. Black box shows the same sequence as 238P1B2 v.1. Numbers correspond to those of 238P1B2 v.1. SNPs are indicated above the box.

238P1B2 SNPs are identified by direct sequencing of the cDNA clones and by comparison of those sequences with public and proprietary sequences. By comparing the sequences with high quality proprietary or public sequences (e.g., NCBI/GenBank, accessible at World Wide Web URL ncbi.nlm.nih.gov), five SNPs of 238P1B2 were identified at nucleotide positions 274 (T/C), 1268 (T/G), 1299 (T/G) 2806 (T/C) and 3025 (T/C). The transcripts or proteins with alternative alleles were designated as variants 238P1B2 v.2, v.3, v.4, v.5 and v.6. FIG. 10 shows the schematic alignment of the nucleotide variants. FIG. 11 shows the schematic alignment of protein variants, corresponding to nucleotide variants. Nucleotide variants that code for the same amino acid sequence as variant 1 are not shown in FIG. 11. These alleles of the SNPs, though shown separately here, can occur in different combinations (haplotypes).

Example 7

Production of Recombinant 238P1B2 in Prokaryotic Systems

To express recombinant 238P1B2 in prokaryotic cells, the full or partial length 238P1B2 variant 1a, variant 1b, and variant 2 cDNA sequences are cloned into any one of a variety of expression vectors known in the art. One or more of the following regions of 238P1B2 variants are expressed in these constructs: amino acids 1 to 254 of variant 1a; amino acids 1 to 316 of variant 1b, and amino acids 1-254 of variant 2, or any 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous amino acids from 238P1B2, variants, or analogs thereof.

A. In Vitro Transcription and Translation Constructs:

pCRII: To generate 238P1B2 sense and anti-sense RNA probes for RNA in situ investigations, pCRII constructs (Invitrogen, Carlsbad Calif.) are generated encoding either all of or fragments of the 238P1B2 cDNA. The pCRII vector has Sp6 and T7 promoters flanking the insert to drive the transcription of 238P1B2 RNA for use as probes in RNA in situ hybridization experiments. These probes are used to analyze the cell and tissue expression of 238P1B2 at the RNA level. Transcribed 238P1B2 RNA representing the cDNA amino acid coding region of the 238P1B2 gene is used in in vitro translation systems such as the TnT™ Coupled Reticulolysate System (Promega, Corp., Madison, Wis.) to synthesize 238P1B2 protein.

B. Bacterial Constructs:

pGEX Constructs: To generate recombinant 238P1B2 proteins in bacteria that are fused to the Glutathione S-transferase (GST) protein, all of or parts of the 238P1B2 cDNA protein coding sequence are fused to the GST gene by cloning into pGEX-6P-1 or any other GST-fusion vector of the pGEX family (Amersham Pharmacia Biotech, Piscataway, N.J.).

These constructs allow controlled expression of recombinant 238P1B2 protein sequences with GST fused at the amino-terminus and a six histidine epitope (6×His) at the carboxyl-terminus. The GST and 6×His tags permit purification of the recombinant fusion protein from induced bacteria with the appropriate affinity matrix and allow recognition of the fusion protein with anti-GST and anti-His antibodies. The 6×His tag is generated by adding 6 histidine codons to the cloning primer at the 3' end, e.g., of the open reading frame (ORF). A proteolytic cleavage site, such as the PreScission™ recognition site in pGEX-6P-1, can be employed to permit cleavage of the GST tag from 238P1B2-related protein. The ampicillin resistance gene and pBR322 origin permits selection and maintenance of the pGEX plasmids in E. coli.

pMAL Constructs: To generate, in bacteria, recombinant 238P1B2 proteins that are fused to maltose-binding protein (MBP), all of or parts of the 238P1B2 cDNA protein coding sequence are fused to the MBP gene by cloning into the pMAL-c2X and pMAL-p2X vectors (New England Biolabs, Beverly, Mass.). These constructs allow controlled expression of recombinant 238P1B2 protein sequences with MBP fused at the amino-terminus and a 6×His epitope tag at the carboxyl-terminus. The MBP and 6×His tags permit purification of the recombinant protein from induced bacteria with the appropriate affinity matrix and allow recognition of the fusion protein with anti-MBP and anti-His antibodies. The 6×His epitope tag is generated by adding 6 histidine codons to the 3' cloning primer. A Factor Xa recognition site permits cleavage of the pMAL tag from 238P1B2. The pMAL-c2X and pMAL-p2X vectors are optimized to express the recombinant protein in the cytoplasm or periplasm respectively. Periplasm expression enhances folding of proteins with disulfide bonds.

pET Constructs: To express 238P1B2 in bacterial cells, all of or parts of the 238P1B2 cDNA protein coding sequence are cloned into the pET family of vectors (Novagen, Madison, Wis.). These vectors allow tightly controlled expression of recombinant 238P1B2 protein in bacteria with and without fusion to proteins that enhance solubility, such as NusA and thioredoxin (Trx), and epitope tags, such as 6×His and S-Tag™ that aid purification and detection of the recombinant protein. For example, constructs are made utilizing pET NusA fusion system 43.1 such that regions of the 238P1B2 protein are expressed as amino-terminal fusions to NusA. In one embodiment, a NusA-fusion protein encompassing amino acids 412-254 of 238P1B2 with a C-terminal 6×His tag was expressed in E. Coli, purified by metal chelate affinity chromatography, and used as an immunogen for generation of antibodies.

C. Yeast Constructs:

pESC Constructs: To express 238P1B2 in the yeast species Saccharomyces cerevisiae for generation of recombinant protein and functional studies, all of or parts of the 238P1B2 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 238P1B2. In addition, expression in yeast yields similar post-translational modifications, such as glycosylations and phosphorylations, that are found when expressed in eukaryotic cells.

pESP Constructs: To express 238P1B2 in the yeast species Saccharomyces pombe, all of or parts of the 238P1B2 cDNA protein coding sequence are cloned into the pESP family of vectors. These vectors allow controlled high level of expression of a 238P1B2 protein sequence that is fused at either the amino terminus or at the carboxyl terminus to GST which aids purification of the recombinant protein. A Flag™ epitope tag allows detection of the recombinant protein with anti-Flag™ antibody.

Example 8

Production of Recombinant 238P1B2 in Eukaryotic Systems

A. Mammalian Constructs:

To express recombinant 238P1B2 in eukaryotic cells, the full or partial length 238P1B2 cDNA sequences can be cloned into any one of a variety of expression vectors known in the art. One or more of the following regions of 238P1B2 are expressed in these constructs: amino acids 1 to 254 of variant 1A or variant 2, amino acids 1 to 316 of variant 1B, or any 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more contiguous amino acids from 238P1B2, variants, or analogs thereof. In certain embodiments a region of a specific variant of 238P1B2 is expressed that encodes an amino acid at a specific position which differs from the amino acid of any other variant found at that position. In other embodiments, a region of a variant of 238P1B2 is expressed that lies partly or entirely within a sequence that is unique to that variant.

The constructs can be transfected into any one of a wide variety of mammalian cells such as 293T cells. Transfected 293T cell lysates can be probed with the anti-238P1B2 polyclonal serum, described herein.

pcDNA4/HisMax Constructs: To express 238P1B2 in mammalian cells, a 238P1B2 ORF, or portions thereof, of 238P1B2 are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6×His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in E. coli.

pcDNA3.1/MycHis Constructs: To express 238P1B2 in mammalian cells, a 238P1B2 ORF, or portions thereof, of 238P1B2 with a consensus Kozak translation initiation site are cloned into pcDNA3.1/MycHis Version A (Invitrogen, Carlsbad, Calif.). Protein expression is driven from the cytomegalovirus (CMV) promoter. The recombinant proteins have the myc epitope and 6×His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in E. coli.

pcDNA3.1/CT-GFP-TOPO Construct: To express 238P1B2 in mammalian cells and to allow detection of the recombinant proteins using fluorescence, a 238P1B2 ORF, or portions thereof, with a consensus Kozak translation initiation site are cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in E. coli. Additional constructs with an amino-terminal GFP fusion are made in pcDNA3.1/NT-GFP-TOPO spanning the entire length of a 238P1B2 protein.

PAPtag: A 238P1B2 ORF, or portions thereof, is cloned into pAPtag-5 (GenHunter Corp. Nashville, Tenn.). This construct generates an alkaline phosphatase fusion at the carboxyl-terminus of a 238P1B2 protein while fusing the IgGκ signal sequence to the amino-terminus. Constructs are also generated in which alkaline phosphatase with an amino-terminal IgGκ signal sequence is fused to the amino-terminus of a 238P1B2 protein. The resulting recombinant 238P1B2 proteins are optimized for secretion into the media of transfected mammalian cells and can be used to identify proteins such as ligands or receptors that interact with 238P1B2 proteins. Protein expression is driven from the CMV promoter and the recombinant proteins also contain myc and 6×His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in E. coli.

ptag5: A 238P1B2 ORF, or portions thereof, is cloned into pTag-5. This vector is similar to pAPtag but without the alkaline phosphatase fusion. This construct generates 238P1B2 protein with an amino-terminal IgGκ signal sequence and myc and 6×His epitope tags at the carboxyl-terminus that facilitate detection and affinity purification. The resulting recombinant 238P1B2 protein is optimized for secretion into the media of transfected mammalian cells, and is used as immunogen or ligand to identify proteins such as ligands or receptors that interact with the 238P1B2 proteins. Protein expression is driven from the CMV promoter. The Zeocin resistance gene present in the vector allows for selection of mammalian cells expressing the protein, and the ampicillin resistance gene permits selection of the plasmid in E. coli.

PsecFc: A 238P1B2 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG1 Fc fusion at the carboxyl-terminus of the 238P1B2 proteins, while fusing the IgGκ signal sequence to N-terminus. 238P1B2 fusions utilizing the murine IgG1 Fc region are also used. The resulting recombinant 238P1B2 proteins are optimized for secretion into the media of transfected mammalian cells, and can be used as immunogens or to identify proteins such as ligands or receptors that interact with 238P1B2 protein. Protein expression is driven from the CMV promoter. The hygromycin resistance gene present in the vector allows for selection of mammalian cells that express the recombinant protein, and the ampicillin resistance gene permits selection of the plasmid in E. coli.

pSRα Constructs: To generate mammalian cell lines that express 238P1B2 constitutively, 238P1B2 ORF, or portions thereof, of 238P1B2 are cloned into pSRα constructs. Amphotropic and ecotropic retroviruses are generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 238P1B2, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in E. coli. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 238P1B2 sequences to allow detection using anti-Flag antibodies. For example, the FLAG™ sequence 5' gat tac aag gat gac gac gat aag 3' (SEQ ID: 18) is added to cloning primer at the 3' end of the ORF. Additional pSRα constructs are made to produce both amino-terminal and carboxyl-terminal GFP and myc/6×His fusion proteins of the full-length 238P1B2 proteins.

Additional Viral Vectors: Additional constructs are made for viral-mediated delivery and expression of 238P1B2. High virus titer leading to high level expression of 238P1B2 is achieved in viral delivery systems such as adenoviral vectors and herpes amplicon vectors. A 238P1B2 coding sequence or fragments thereof is amplified by PCR and subcloned into the AdEasy shuttle vector (Stratagene). Recombination and virus packaging are performed according to the manufacturer's instructions to generate adenoviral vectors. Alternatively, 238P1B2 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 238P1B2 in mammalian cells, coding sequences of 238P1B2, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 238P1B2. These vectors are thereafter used to control expression of 238P1B2 in various cell lines such as PC3, NIH 3T3, 293 or rat-1 cells.

B. Baculovirus Expression Systems

To generate recombinant 238P1B2 proteins in a baculovirus expression system, 238P1B2 ORF, or portions thereof, are cloned into the baculovirus transfer vector pBlueBac 4.5 (Invitrogen), which provides a His-tag at the N-terminus. Specifically, pBlueBac-238P1B2 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 238P1B2 protein is then generated by infection of HighFive insect cells (Invitrogen) with purified baculovirus. Recombinant 238P1B2 protein can be detected using anti-238P1B2 or anti-His-tag antibody. 238P1B2 protein can be purified and used in various cell-based assays or as immunogen to generate polyclonal and monoclonal antibodies specific for 238P1B2.

Example 9

Antigenicity Profiles and Secondary Structure

FIG. 5A,B, FIG. 6A,B, FIG. 7A,B, FIG. 8A,B, and FIG. 9A,B depict graphically five amino acid profiles of the 238P1B2 variant 1a (5A-9a) amino acid sequence and variant 1b (5B-9B), each assessment available by accessing the ProtScale website on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of the 238P1B2 protein. Each of the above amino acid profiles of 238P1B2 were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus be available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible for immune recognition, such as by antibodies.

Antigenic sequences of the 238P1B2 variant 1a and variant 1b protein indicated, e.g., by the profiles set forth in FIG. 5A,B, FIG. 6 A,B, FIG. 7A,B, FIG. 8A,B, and/or FIG. 9A,B are used to prepare immunogens, either peptides or nucleic acids that encode them, to generate therapeutic and diagnostic anti-238PIB2 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 238P1B2 variant proteins. In particular, peptide immunogens for 238P1B2 variant 1a of the invention can comprise, a peptide region of at least 5 amino acids of FIG. 2 in any whole number increment up to 254 that includes an amino acid position having a value greater than 0.5 in the Hydrophilicity profile of FIG. 5A; a peptide region of at least 5 amino acids of FIG. 2 in any whole number increment up to 254 that includes an amino acid position having a value less than 0.5 in the Hydropathicity profile of FIG. 6A; a peptide region of at least 5 amino acids of FIG. 2 in any whole number increment up to 254 that includes an amino acid position having a value greater than 0.5 in the Percent Accessible Residues profile of FIG. 7A; a peptide region of at least 5 amino acids of FIG. 2 in any whole number increment up to 254 that includes an amino acid position having a value greater than 0.5 in the Average Flexibility profile on FIG. 8A; and, a peptide region of at least 5 amino acids of FIG. 2 in any whole number increment up to 254 that includes an amino acid position having a value greater than 0.5 in the Beta-turn profile of FIG. 9A.

In addition, peptide immunogens for 238P1B2 variant 1b of the invention can comprise, a peptide region of at least 5 amino acids of FIG. 2 in any whole number increment up to 316 that includes an amino acid position having a value greater than 0.5 in the Hydrophilicity profile of FIG. 5B; a peptide region of at least 5 amino acids of FIG. 2 in any whole number increment up to 316 that includes an amino acid position having a value less than 0.5 in the Hydropathicity profile of FIG. 6B; a peptide region of at least 5 amino acids of FIG. 2 in any whole number increment up to 316 that includes an amino acid position having a value greater than 0.5 in the Percent Accessible Residues profile of FIG. 7B; a peptide region of at least 5 amino acids of FIG. 2 in any whole number increment up to 316 that includes an amino acid position having a value greater than 0.5 in the Average Flexibility profile on FIG. 8B; and, a peptide region of at least 5 amino acids of FIG. 2 in any whole number increment up to 316 that includes an amino acid position having a value greater than 0.5 in the Beta-turn profile of FIG. 9B. Immunogens of the invention can also comprise nucleic acids that encode any of the foregoing peptides.

All immunogens of the invention, whether peptides or nucleic acids, can be embodied in human unit dose form, or comprised by a composition that includes a pharmaceutical excipient compatible with human physiology.

The secondary structure of 238P1B2, namely the predicted presence and location of alpha helices, extended strands, and random coils, is predicted from the primary amino acid sequence using the HNN—Hierarchical Neural Network method (Guermeur, 1997), accessed from the ExPasy molecular biology server. The analysis indicates that 238P1B2 variant 1a is composed of 66.54% alpha helix, 6.69% extended strand, and 26.77% random coil (FIG. 12A). The analysis indicates that 238P1B2 variant 1b is composed of 61.71% alpha helix, 8.86% extended strand, and 29.43% random coil (FIG. 12B).

Figure 12D:
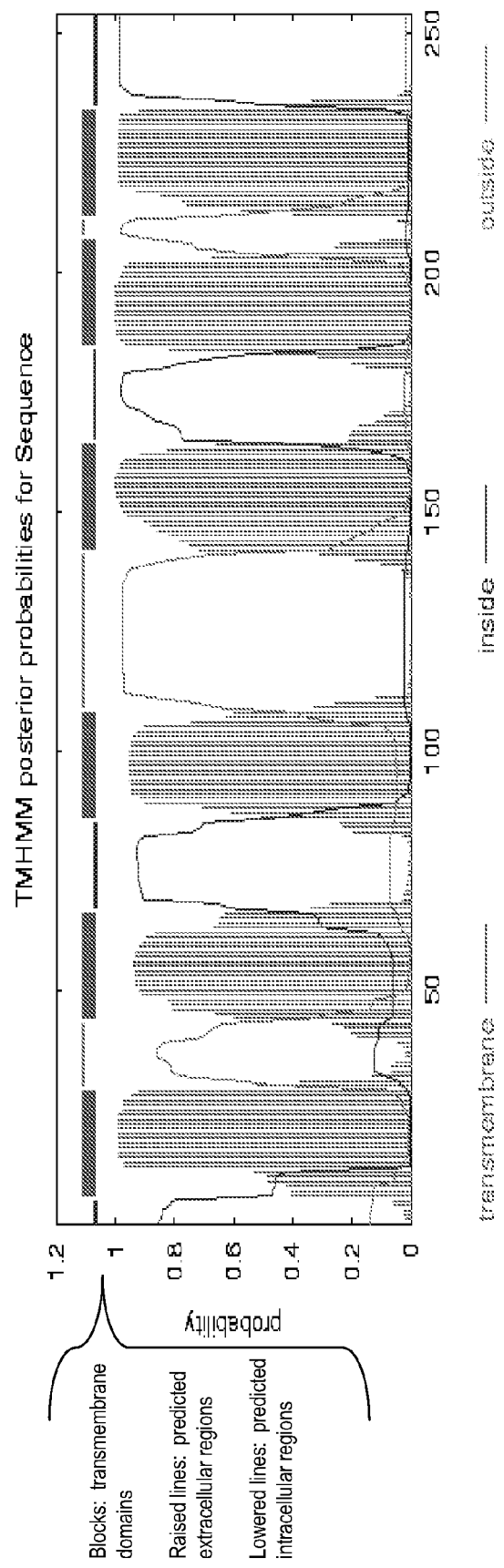
FIG. 12. A, B. Secondary structure prediction for 238P1B2 variant 1a (SEQ ID: 8901) and variant 1b (SEQ ID: 8902). The secondary structures of 238P1B2 variant 1a (A) and of variant 1b (B) proteins were predicted using the HNN—Hierarchical Neural Network method (Guermeur, 1997), accessed from the ExPasy molecular biology server. This method predicts the presence and location of alpha helices, extended strands, and random coils from the primary protein sequence. The percent of the protein in a given secondary structure is also listed for each variant.
Figure 12F:
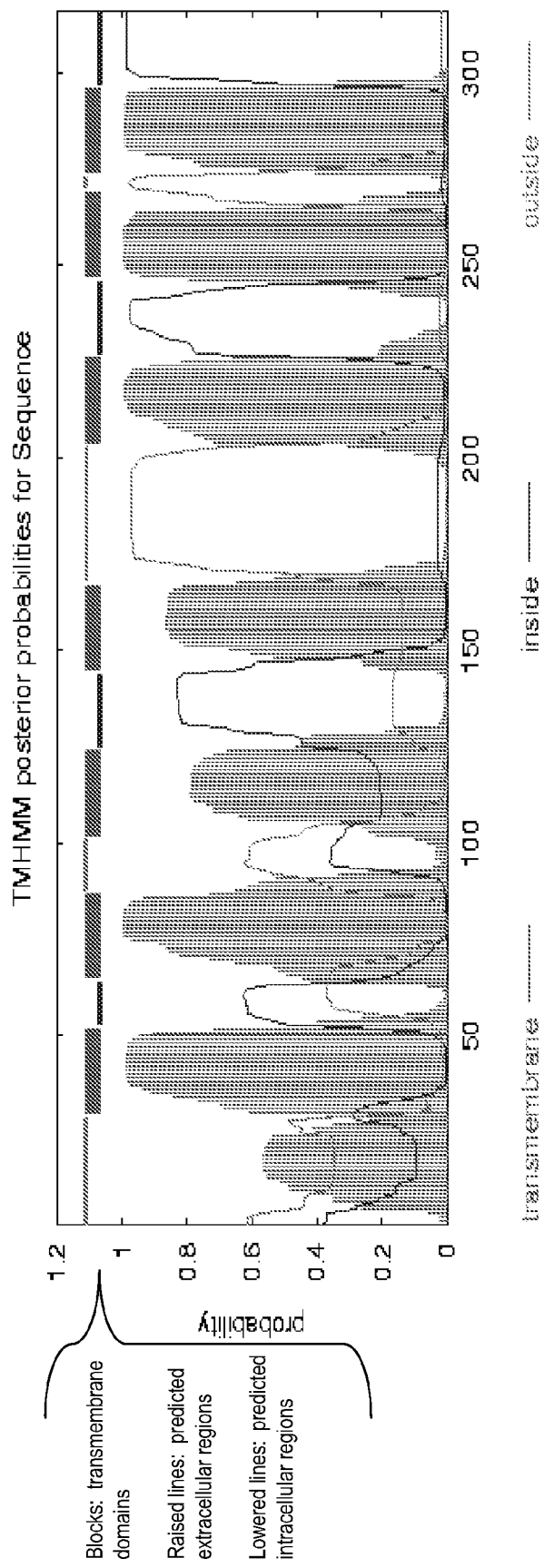

Analysis for the potential presence of transmembrane domains in 238P1B2 was carried out using a variety of transmembrane prediction algorithms accessed from the ExPasy molecular biology server. The programs predict the presence of multiple transmembrane domains in 238P1B2 variant 1a and variant 1b. The highest probability of topology for variant 1a is that of a cell surface protein with 6 transmembrane domains. The highest probability of topology for variant 1b is that of a cell surface protein with 7 transmembrane domains, consistent with that of a G-protein coupled receptor. Shown graphically in FIG. 12C and FIG. 12D are the results of analysis of 238P1B2 variant 1a using the TMpred (FIG. 12C) and TMHMM (FIG. 12D) prediction programs depicting the location and topology of the 6 transmembrane domains. Shown in FIG. 12E and FIG. 12F are the results of the prediction programs for 238P1B2 variant 1b showing the location and topology of the 7 transmembrane domains. The results of each program, namely the amino acids encoding the transmembrane domain, are summarized in Table XXII.

Example 10

Generation of 238P1B2 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with the full length 238P1B2 protein, computer algorithms are employed in design of immunogens that, based on amino acid sequence analysis contain characteristics of being antigenic and available for recognition by the immune system of the immunized host (see the Example entitled "Antigenicity Profiles"). Such regions would be predicted to be hydrophilic, flexible, in beta-turn conformations, and/or be exposed on the surface of the protein (see, e.g., FIG. 5A,B, FIG. 6A,B, FIG. 7A,B, FIG. 8A,B, and FIG. 9A,B for amino acid profiles that indicate such regions of 238P1B2 variants 1a and 1b).

For example, 238P1B2 recombinant bacterial fusion proteins or peptides containing hydrophilic, flexible, beta-turn regions of the 238P1B2 variant 1, generally found in regions between transmembrane domains and at the amino and carboxyl termini, are used as antigens to generate polyclonal antibodies in New Zealand White rabbits. Examples of such regions include, but are not limited to, amino acids 30-43, amino acids 109-141, and amino acids 208-211, which are regions that are predicted to be extracellular; and amino acids 67-85, amino acids 165-184, and amino acids 235-254, which are regions predicted to be intracellular. In addition, the amino-terminal region of variant 1b, amino acids 1-29 can be used as an immunogen. Antibodies to this region are useful to distinguish variant 1b protein from variant 1a protein. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 1-29 of 238P1B2 variant 1b is conjugated to KLH and used to immunize the rabbit. Alternatively the immunizing agent can include all or portions of the 238P1B2 protein, analogs or fusion proteins thereof. For example, the 238P1B2 amino acid sequence can be fused using recombinant DNA techniques to any one of a variety of fusion protein partners that are well known in the art, such as glutathione-S-transferase (GST) and HIS tagged fusion proteins. Such fusion proteins are purified from induced bacteria using the appropriate affinity matrix.

In one embodiment, a GST-fusion protein encoding amino acids 1-254 of variant 1a is produced and purified and used as immunogen. Other recombinant bacterial fusion proteins that can be employed include maltose binding protein, LacZ, thioredoxin, NusA, or an immunoglobulin constant region (see the section entitled "Production of 238P1B2 in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Damle, N., and Ledbetter, L. (1991) J. Exp. Med. 174, 561-566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 238P1B2 in Eukaryotic Systems"), and retain post-translational modifications such as glycosylations found in native protein. In one embodiment, amino acids 109-141 of variant 1a are cloned into the Tag5 mammalian secretion vector. The recombinant protein is purified by metal chelate chromatography from tissue culture supernatants of 293T cells stably expressing the recombinant vector. The purified Tag5 238P1B2 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100-200 µg, of fusion protein or peptide conjugated to KLH mixed in complete Freund's adjuvant (CFA). Rabbits are then injected subcutaneously every two weeks with up to 200 µg, typically 100-200 µg, of the immunogen in incomplete Freund's adjuvant (IFA). Test bleeds are taken approximately 7-10 days following each immunization and used to monitor the titer of the antiserum by ELISA.

To test reactivity and specificity of immune serum, such as the rabbit serum derived from immunization with Tag5 238PIB2 variant 1a encoding amino acids 109-141, the full-length 238P1B2 cDNA is cloned into pcDNA 3.1 myc-his expression vector (Invitrogen, see the Example entitled "Production of Recombinant 238P1B2 in Eukaryotic Systems"). After transfection of the constructs into 293T cells, cell lysates are probed with the anti-238P1B2 antibodies and with anti-His antibody (Santa Cruz Biotechnologies, Santa Cruz, Calif.) to determine specific reactivity of the antibodies to denatured 238P1B2 protein using the Western blot technique. Immunoprecipitation and flow cytometric analyses of 293T and other recombinant 238P1B2-expressing cells determine recognition of native protein by the antibodies. In addition, Western blot, immunoprecipitation, fluorescent microscopy, and flow cytometric techniques using cells that endogenously express 238P1B2 are carried out to test specificity.

Anti-serum from rabbits immunized with 238P1B2 fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-238P1B2 fusion protein encoding amino acids 1-254 of variant 1a is first purified by passage over a column of GST protein covalently coupled to AffiGel matrix (BioRad, Hercules, Calif.). The antiserum is then affinity purified by passage over a column composed of a MBP-fusion protein also encoding amino acids 1-254 of variant 1a covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of 238P1B2 Monoclonal Antibodies (mAbs)

In one embodiment, therapeutic mAbs to 238P1B2 comprise those that react with epitopes of the protein that would disrupt or modulate the biological function of 238P1B2, for example antibodies that disrupt its interaction with ligands and binding partners. Therapeutic mAbs also comprise those that specifically bind epitopes of 238P1B2 exposed on the cell surface and thus are useful in targeting mAb-toxin conjugates. Immunogens for generation of such mAbs include those designed to encode or contain the entire 238P1B2 protein, regions of the 238P1B2 protein predicted to be antigenic from computer analysis of the amino acid sequence (see, e.g., FIG. 5A,B, FIG. 6A,B, FIG. 7A,B, FIG. 8A,B, or FIG. 9A,B, and the Example entitled "Antigenicity Profiles"), and regions such as predicted extracellular domains. Immunogens include peptides, recombinant bacterial proteins, and mammalian expressed Tag 5 proteins and human and murine IgG FC fusion proteins. In addition, cells expressing high levels of 238P1B2, such as 293T-238P1B2 or 300.19-238P1B2 murine Pre-B cells, are used to immunize mice.

To generate mAbs to 238P1B2, mice are first immunized intraperitoneally (IP) with, typically, 10-50 µg of protein immunogen or $10^7$ 238P1B2-expressing cells mixed in complete Freund's adjuvant. Mice are then subsequently immunized IP every 2-4 weeks with, typically, 10-50 µg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding 238P1B2 sequence is used to immunize mice by direct injection of the plasmid DNA. For example, amino acids 109-141 is cloned into the Tag5 mammalian secretion vector and the recombinant vector is used as immunogen. In another example the same amino acids are cloned into an Fc-fusion secretion vector in which the 238P1B2 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing 238P1B2.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 238P1B2 monoclonal antibodies, a Tag5-238P1B2 antigen encoding amino acids 109-141 of variant 1a, a predicted extracellular domain, is expressed and purified from stably transfected 293T cells. Balb C mice are initially immunized intraperitoneally with 25 µg of the Tag5 238P1B2 protein mixed in complete Freund's adjuvant. Mice are subsequently immunized every two weeks with 25 µg of the antigen mixed in incomplete Freund's adjuvant for a total of three immunizations. ELISA using the Tag5 antigen determines the titer of serum from immunized mice. Reactivity and specificity of serum to full length 238P1B2 protein is monitored by Western blotting, immunoprecipitation and flow cytometry using 293T cells transfected with an expression vector encoding the 238P1B2 cDNA (see e.g., the Example entitled "Production of Recombinant 238P1B2 in Eukaryotic Systems"). Other recombinant 238P1B2-expressing cells or cells endogenously expressing 238P1B2 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescence microscopy, and flow cytometry to identify 238P1B2 specific antibody-producing clones.

The binding affinity of a 238P1B2 monoclonal antibody is determined using standard technologies. Affinity measurements quantify the strength of antibody to epitope binding and are used to help define which 238P1B2 monoclonal antibodies are suitable for diagnostic or therapeutic use, as appreciated by one of skill in the art. The BIAcore system (Uppsala, Sweden) is a useful method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., Current Protocols in Immunology 18.3.1 (1998); Sidney, et al., J. Immunol. 154:247 (1995); Sette, et al., Mol. Immunol. 31:813 (1994)). Briefly, purified MHC molecules (5 to 500 nM) are incubated with various unlabeled peptide inhibitors and 1-10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and $IC_{50} \geqq$ [HLA], the measured $IC_{50}$ values are reasonable approximations of the true $K_D$ values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides.

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-bearing Epitopes The searches performed to identify the motif-bearing peptide sequences in the Example entitled "Antigenicity Profiles" and Tables V-XVIII and Table XIX, employ the protein sequence data from the gene product of 238P1B2 set forth in FIGS. 2 and 3.

Computer searches for epitopes bearing HLA Class I or Class II supermotifs or motifs are performed as follows. All translated 238P1B2 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or $\Delta G$) of peptide-HLA molecule interactions can be approximated as a linear polynomial function of the type:

$$\text{"}\Delta G\text{"} = a_{1i} \times a_{2i} \times a_{3i} \cdots \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-reactive Peptides

Protein sequences from 238P1B2 are scanned utilizing motif identification software, to identify 8-, 9-10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-bearing Epitopes

The 238P1B2 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of $\leq$500 nM, often $\leq$200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 238P1B2 protein(s) scanned above is also analyzed for the presence of 8-, 9-10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of $\leq$500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-bearing Epitopes

To further increase population coverage, HLA-A1 and -A24 epitopes can also be incorporated into vaccine compositions. An analysis of the 238P1B2 protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The 221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about $200\text{-}250\times10^6$ PBMC are processed to obtain $24\times10^6$ CD8$^+$ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 μl beads/$20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with 40 μg/ml of peptide at a cell concentration of $1\text{-}2\times10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml $\beta_2$ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., *Critical Reviews in Immunology* 18(1-2):65-75, 1998). Seven days later, the cultures are assayed for CTL activity in a $^{51}$Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}$Cr Release.

Seven days after the second restimulation, cytotoxicity is determined in a standard (5 hr) $^{51}$Cr release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}$Cr sodium chromate (Dupont, Wilmington, Del.) for 1 hour at 37° C. Labeled target cells are resuspended at $10^6$ per ml and diluted 1:10 with K562 cells at a concentration of $3.3\times10^6$/ml (an NK-sensitive erythroblastoma cell line used to reduce non-specific lysis). Target cells (100 μl) and effectors (100 μl) are plated in 96 well round-bottom plates and incubated for 5 hours at 37° C. At that time, 100 μl of supernatant are collected from each well and percent lysis is determined according to the formula: [(cpm of the test sample–cpm of the spontaneous $^{51}$Cr release sample)/(cpm of the maximal $^{51}$Cr release sample–cpm of the spontaneous $^{51}$Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In Situ Measurement of Human IFNγ Production as an Indicator of Peptide-specific and Endogenous Recognition Immulon 2 plates are coated with mouse anti-human IFNγ monoclonal antibody (4 μg/ml 0.1M NaHCO$_3$, pH8.2) overnight at 4° C. The plates are washed with Ca$^{2+}$, Mg$^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1\times10^6$ cells/ml. The plates are incubated for 48 hours at 37° C. with 5% CO$_2$.

Recombinant human IFN-gamma is added to the standard wells starting at 400 μg or 1200 μg/100 microliter/well and the plate incubated for two hours at 37° C. The plates are washed and 100 μl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1M H$_3$PO$_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5\times10^4$ CD8+ cells are added to a T25 flask containing the following: $1\times10^6$ irradiated (4,200 rad) PBMC (autologous or allogeneic) per ml, $2\times10^5$ irradiated (8,000 rad) EBV—transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds 1×10⁶/ml and the cultures are assayed between days 13 and 15 at E:T ratios of 30, 10, 3 and 1:1 in the $^{51}$Cr release assay or at 1×10⁶/ml in the in situ IFNγ assay using the same targets as before the expansion.

Cultures are expanded in the absence of anti-CD3⁺ as follows. Those cultures that demonstrate specific lytic activity against peptide and endogenous targets are selected and 5×10⁴ CD8⁺ cells are added to a T25 flask containing the following: 1×10⁶ autologous PBMC per ml which have been peptide-pulsed with 10 μg/ml peptide for two hours at 37° C. and irradiated (4,200 rad); 2×10⁵ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 238P1B2. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus. To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an IC$_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-supermotif-bearing Peptides

Analogs of HLA-A3 supermotif-bearing epitopes are generated using strategies similar to those employed in analoging HLA-A2 supermotif-bearing peptides. For example, peptides binding to ⅗ of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol.* 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position I is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 238P1B2-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g. the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 238P1B2-derived Sequences with HLA-DR Binding Motifs Peptide epitopes bearing an HLA class II supermotif or motif are identified and confirmed as outlined below using methodology similar to that described for HLA Class I peptides.

Selection of HLA-DR-supermotif-bearing Epitopes.

To identify 238P1B2-derived, HLA class II HTL epitopes, a 238P1B2 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol.* 160:3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 238P1B2-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 238P1B2-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 238P1B2 antigens are analyzed for sequences carrying one of the two DR3-specific binding motifs reported by Geluk et al. (*J. Immunol.* 152:5742-5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 238P1B2-derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 238P1B2-expressing tumors.

Example 18

Calculation of Phenotypic Frequencies of HLA-supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1−af)) (see, e.g., Sidney et al., *Human Immunol.* 45:79-93, 1996). To obtain overall phenotypic frequencies, cumulative gene frequencies are calculated, and the cumulative antigen frequencies derived by the use of the inverse formula [$af=1-(1-Cgf)^2$].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Immunogenicity studies in humans (e.g., Bertoni et al., *J. Clin. Invest.* 100:503, 1997; Doolan et al., *Immunity* 7:97, 1997; and Threlkeld et al., *J. Immunol.* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition Of Endogenously Processed Antigens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 238P1B2 expression vectors.

The results demonstrate that CTL lines obtained from animals primed with peptide epitope recognize endogenously synthesized 238P1B2 antigen. The choice of transgenic mouse model to be used for such an analysis depends upon the epitope(s) that are being evaluated. In addition to HLA-A*020$_1$/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity Of CTL-HTL Conjugated Epitopes in Transgenic Mice

This example illustrates the induction of CTLs and HTLs in transgenic mice, by use of a 238P1B2-derived CTL and HTL peptide vaccine compositions. The vaccine composition used herein comprise peptides to be administered to a patient with a 238P1B2-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vitiello et al., *J. Exp. Med.* 173:1007, 1991)

In vitro CTL activation: One week after priming, spleen cells (30×10$^6$ cells/flask) are co-cultured at 37° C. with syngeneic, irradiated (3000 rads), peptide coated lymphoblasts (10×10$^6$ cells/flask) in 10 ml of culture medium/T25 flask. After six days, effector cells are harvested and assayed for cytotoxic activity.

Assay for cytotoxic activity: Target cells (1.0 to 1.5×10$^6$) are incubated at 37° C. in the presence of 200 μl of $^{51}$Cr. After 60 minutes, cells are washed three times and resuspended in R10 medium. Peptide is added where required at a concentration of 1 μg/ml. For the assay, 10$^4$ $^{51}$Cr-labeled target cells are added to different concentrations of effector cells (final volume of 200 μl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E):

target (T) ratio of 50:1 (i.e., $5\times10^5$ effector cells for 10,000 targets) in the absence of peptide and 5:1 (i.e., $5\times10^4$ effector cells for 10,000 targets) in the presence of peptide, the specific lytic units would be: $[(1/50,000)-(1/500,000)]\times10^6=18$ LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity". Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in an 238P1B2-specific Vaccine

This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 238P1B2 clearance. The number of epitopes used depends on observations of patients who spontaneously clear 238P1B2. For example, if it has been observed that patients who spontaneously clear 238P1B2 generate an immune response to at least three (3) from 238P1B2 antigen, then three or four (3-4) epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site.

In order to achieve broad coverage of the vaccine throughout a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 238P1B2, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 238P1B2.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 238P1B2, are selected such that multiple supermotifs/motifs are represented to ensure broad population coverage. Similarly, HLA class II epitopes are selected from 238P1B2 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 µg of each of two oligonucleotides are annealed and extended: In an example using eight oligonucleotides, i.e., four pairs of primers, oligonucleotides 1+2, 3+4, 5+6, and 7+8 are combined in 100 µl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 µg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature* 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 µg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}Cr$ release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, 1-$A^b$-restricted mice, for example, are immunized intramuscularly with 100 µg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3H$-thymidine incorporation proliferation assay, (see, e.g., Alexander et al. Immunity 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med.* 5:526-34, 1999).

For example, the efficacy of the DNA minigene used in a prime boost protocol is initially evaluated in transgenic mice. In this example, A2.1/$K^b$ transgenic mice are immunized IM with 100 µg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 µg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 238P1B2 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 238P1B2-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 µg, generally 100-5,000 µg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 238P1B2-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 238P1B2 Sequences

A native 238P1B2 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes is selected; it can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 238P1B2 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (excluding an analoged embodiment) directs the immune response to multiple peptide sequences that are actually present in native 238P1B2, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The 238P1B2 peptide epitopes of the present invention are used in conjunction with epitopes from other target tumor-associated antigens, to create a vaccine composition that is useful for the prevention or treatment of cancer that expresses 238P1B2 and such other antigens. For example, a vaccine composition can be provided as a single polypeptide that incorporates multiple epitopes from 238P1B2 as well as tumor-associated antigens that are often expressed with a target cancer associated with 238P1B2 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 238P1B2. Such an analysis can be performed in a manner described by Ogg et al., *Science* 279:

2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 238P1B2 HLA-A*0201-specific CTL frequencies from HLA A*0201-positive individuals at different stages of disease or following immunization comprising an 238P1B2 peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 238P1B2 epitope, and thus the status of exposure to 238P1B2, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 238P1B2-associated disease or who have been vaccinated with an 238P1B2 vaccine.

For example, the class I restricted CTL response of persons who have been vaccinated may be analyzed. The vaccine may be any 238P1B2 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 μg/ml), and Hepes (10 mM) containing 10% heat-inactivated human AB serum (complete RPMI) and plated using microculture formats. A synthetic peptide comprising an epitope of the invention is added at 10 μg/ml to each well and HBV core 128-140 epitope is added at 1 μg/ml to each well as a source of T cell help during the first week of stimulation.

In the microculture format, $4 \times 10^5$ PBMC are stimulated with peptide in 8 replicate cultures in 96-well round bottom plate in 100 μl/well of complete RPMI. On days 3 and 10, 100 μl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., *Nature Med.* 2:1104, 1108, 1996; Rehermann et al., *J. Clin. Invest.* 97:1655-1665, 1996; and Rehermann et al. *J. Clin. Invest.* 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 μM, and labeled with 100 μCi of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release−spontaneous release)/maximum release−spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 238P1B2 or an 238P1B2 vaccine.

Similarly, Class II restricted HTL responses may also be analyzed. Purified PBMC are cultured in a 96-well flat bottom plate at a density of $1.5 \times 10^5$ cells/well and are stimulated with 10 μg/ml synthetic peptide of the invention, whole 238P1B2 antigen, or PHA. Cells are routinely plated in replicates of 4-6 wells for each condition. After seven days of culture, the medium is removed and replaced with fresh medium containing 10 U/ml IL-2. Two days later, 1 μCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 29

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing 238P1B2

Phase II trials are performed to study the effect of administering the CTL-HTL peptide compositions to patients having cancer that expresses 238P1B2. The main objectives of the trial are to determine an effective dose and regimen for inducing CTLs in cancer patients that express 238P1B2, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses 238P1B2.

Clinical manifestations or antigen-specific T-cell responses are monitored to assess the effects of administering the peptide compositions. The vaccine composition is found to be both safe and efficacious in the treatment of 238P1B2-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of 'Minigene' Multi-Epitope DNA Plasmids" in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5-10^7$ to $5 \times 10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 238P1B2 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 238P1B2 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2-50 \times 10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5 \times 10^6$ DC, then the patient will be injected with a total of $2.5 \times 10^8$ peptide-loaded PBMC. The percent DC mobilized by an agent such as Progenipoietin™ is typically estimated to be between 2-10%, but can vary as appreciated by one of skill in the art.

Ex Vivo Activation of CTL/HTL Responses

Alternatively, ex vivo CTL or HTL responses to 238P1B2 antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 238P1B2. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 238P1B2 to isolate peptides corresponding to 238P1B2 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 238P1B2-encoding sequences, or any parts thereof, are used to detect, decrease, or inhibit expression of naturally occurring 238P1B2. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 238P1B2. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 238P1B2-encoding transcript.

Example 35

Purification of Naturally-occurring or Recombinant 238P1B2 Using 238P1B2 Specific Antibodies Naturally occurring or recombinant 238P1B2 is substantially purified by immunoaffinity chromatography using antibodies specific for 238P1B2. An immunoaffinity column is constructed by covalently coupling anti-238P1B2 antibody to an activated chromatographic resin, such as CNBr-activated SEPHAROSE (Amersham Pharmacia Biotech). After the coupling, the resin is blocked and washed according to the manufacturer's instructions.

Media containing 238P1B2 are passed over the immunoaffinity column, and the column is washed under conditions that allow the preferential absorbance of 238P1B2 (e.g., high ionic strength buffers in the presence of detergent). The column is eluted under conditions that disrupt antibody/238P1B2 binding (e.g., a buffer of pH 2 to pH 3, or a high concentration of a chaotrope, such as urea or thiocyanate ion), and GCR.P is collected.

Example 36

Identification of Molecules which Interact with 238P1B2

238P1B2, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 238P1B2, washed, and any wells with labeled 238P1B2 complex are assayed. Data obtained using different concentrations of 238P1B2 are used to calculate values for the number, affinity, and association of 238P1B2 with the candidate molecules.

Example 37

In Vivo Assay for 238P1B2 Tumor Growth Promotion

The effect of the 238P1B2 protein on tumor cell growth is evaluated in vivo by gene overexpression in tumor-bearing mice. For example, SCID mice are injected subcutaneously on each flank with $1 \times 10^6$ of either PC3, DU145 or 3T3 cells containing tkNeo empty vector or 238P1B2. At least two strategies can be used: (1) Constitutive 238P1B2 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tet, etc., provided such promoters are compatible with the host cell systems. Tumor volume is then monitored at the appearance of palpable tumors and followed over time to determine if 238P1B2-expressing cells grow at a faster rate and whether tumors produced by 238P1B2-expressing cells demonstrate characteristics of altered aggressiveness (e.g. enhanced metastasis, vascularization, reduced responsiveness to chemotherapeutic drugs).

Additionally, mice can be implanted with $1 \times 10^5$ of the same cells orthotopically to determine if 238P1B2 has an effect on local growth in the prostate or on the ability of the cells to metastasize, specifically to lungs, lymph nodes, and bone marrow.

The assay is also useful to determine the 238P1B2 inhibitory effect of candidate therapeutic compositions, such as for example, 238P1B2 intrabodies, 238P1B2 antisense molecules and ribozymes.

Example 38

238P1B2 Monoclonal Antibody-mediated Inhibition of Prostate Tumors In Vivo

The significant expression of 238P1B2 in prostate cancer tissues and its restrictive expression in normal tissues, together with its expected cell surface expression, makes 238P1B2 an excellent target for antibody therapy. Similarly, 238P1B2 is a target for T cell-based immunotherapy. Thus, the therapeutic efficacy of anti-238P1B2 mAbs in human prostate cancer xenograft mouse models is evaluated by using human cancer xenografts (Craft, N., et al., Cancer Res, 1999. 59(19): p. 5030-6) and the androgen independent recombinant cell line PC3-238P1B2 (see, e.g., Kaighn, M. E., et al., Invest Urol, 1979. 17(1): p. 16-23).

Antibody efficacy on tumor growth and metastasis formation is studied, e.g., in a mouse orthotopic prostate cancer xenograft models and mouse kidney xenograft models. The antibodies can be unconjugated, as discussed in this Example, or can be conjugated to a therapeutic modality, as appreciated in the art. Anti-238P1B2 mAbs inhibit formation of androgen-independent PC3-238P1B2 tumor xenografts. Anti-238P1B2 mAbs also retard the growth of established orthotopic tumors and prolonged survival of tumor-bearing mice. These results indicate the utility of anti-238P1B2 mAbs in the treatment of local and advanced stages of prostate cancer. (See, e.g., Saffran, D., et al., PNAS 10:1073-1078).

Administration of the anti-238P1B2 mAbs led to retardation of established orthotopic tumor growth and inhibition of metastasis to distant sites, resulting in a significant prolongation in the survival of tumor-bearing mice. These studies indicate that 238P1B2 as an attractive target for immunotherapy and demonstrate the therapeutic potential of anti-238P1B2 mAbs for the treatment of local and metastatic prostate cancer. This example demonstrates that unconjugated 238P1B2 monoclonal antibodies are effective to inhibit the growth of human prostate tumor xenografts and human kidney xenografts grown in SCID mice; accordingly a combination of such efficacious monoclonal antibodies is also effective.

Tumor Inhibition Using Multiple Unconjugated 238P1B2 mAbs

Materials and Methods

238P1B2 Monoclonal Antibodies:

Monoclonal antibodies are raised against 238P1B2 as described in the Example entitled "Generation of 238P1B2 Monoclonal Antibodies (mAbs)." The antibodies are characterized by ELISA, Western blot, FACS, and immunoprecipitation for their capacity to bind 238P1B2. Epitope mapping data for the anti-238P1B2 mAbs, as determined by ELISA and Western analysis, indicates that the antibodies recognize epitopes on the 238P1B2 protein. Immunohistochemical analysis of prostate cancer tissues and cells with these antibodies is performed.

The monoclonal antibodies are purified from ascites or hybridoma tissue culture supernatants by Protein-G Sepharose chromatography, dialyzed against PBS, filter sterilized, and stored at $-20°$ C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of LAPC-9 prostate tumor xenografts.

Cancer Xenografts and Cell Lines

Human cancer xenograft models as well as ICR-severe combined immunodeficient (SCID) mice injected with human cell lines expressing or lacking 238P1B2 are used to confirm the role of this gene in tumor growth and progression. Prostate xenograft tissue is passaged in 6- to 8-week-old male SCID mice (Taconic Farms) by s.c. trocar implant (Craft, N., et al., supra). The prostate carcinoma cell line PC3 (American Type Culture Collection) is maintained in RPMI supplemented with L-glutamine and 10% FBS.

PC3-238P1B2 and 3T3-238P1B2 cell populations are generated by retroviral gene transfer as described in Hubert, R. S., et al., STEAP: a prostate-specific cell-surface antigen highly expressed in human prostate tumors. Proc Natl Acad Sci USA, 1999. 96(25): p. 14523-8. Anti-238P1B2 staining is detected by using an FITC-conjugated goat anti-mouse antibody (Southern Biotechnology Associates) followed by analysis on a Coulter Epics-XL flow cytometer.

Xenograft Mouse Models.

Subcutaneous (s.c.) tumors are generated by injection of $1 \times 10^6$ cells, such as PC3, PC3-238P1B2, 3T3 or 3T3-238P1B2 cells mixed at a 1:1 dilution with Matrigel (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant antigen not expressed in human cells. Tumor sizes are determined by vernier caliper measurements, and the tumor volume is calculated as length×width×height. Mice with s.c. tumors greater than 1.5 cm in diameter are sacrificed. PSA levels are determined by using a PSA ELISA kit (Anogen, Mississauga, Ontario). Circulating levels of anti-238P1B2 mAbs are determined by a capture ELISA kit (Bethyl Laboratories, Montgomery, Tex.). (See, e.g., (Saffran, D., et al., PNAS 10:1073-1078).

Orthotopic injections are performed under anesthesia by using ketamine/xylazine. For prostate orthotopic studies, an incision is made through the abdominal muscles to expose the bladder and seminal vesicles, which then are delivered through the incision to expose the dorsal prostate. PC3 cells ($5 \times 10^5$) mixed with Matrigel are injected into each dorsal lobe in a 10-μl volume. To monitor tumor growth, mice are bled on a weekly basis for determination of PSA levels. The mice are segregated into groups for the appropriate treatments, with anti-238P1B2 or control mAbs being injected i.p.

Anti-238P1B2 mAbs Inhibit Growth of 238P1B2-Expressing Xenograft-Cancer Tumors

The effect of anti-238P1B2 mAbs on tumor formation is tested by using PC3-238P1B2 orthotopic models. As compared with the s.c. tumor model, the orthotopic model, which requires injection of tumor cells directly in the mouse prostate or kidney, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem, 1994. 56(1): p. 4-8). The features make the orthotopic model more representative of human disease progression and allowed us to follow the therapeutic effect of mAbs on clinically relevant end points.

Accordingly, tumor cells are injected into the mouse prostate or kidney, and 2 days later, the mice are segregated into two groups and treated with either: a) 200-500 μg, of anti-238P1B2 Ab, or b) PBS three times per week for two to five weeks.

A major advantage of the orthotopic prostate-cancer model is the ability to study the development of metastases. Formation of metastasis in mice bearing established orthotopic tumors is studied by IHC analysis on lung sections using an antibody against a prostate-specific cell-surface protein STEAP expressed at high levels in LAPC-9 xenografts (Hubert, R. S., et al., Proc Natl Acad Sci USA, 1999. 96(25): p. 14523-8).

Mice bearing established orthotopic 3T3-238P1B2 and PC3-238P1B2 tumors are administered 1000 μg injections of either anti-238P1B2 mAb or PBS over a 4-week period. Mice in both groups are allowed to establish a high tumor burden, to ensure a high frequency of metastasis formation in mouse lungs. Mice then are killed and their prostate and lungs are analyzed for the presence of tumor cells by IHC analysis.

These studies demonstrate a broad anti-tumor efficacy of anti-238P1B2 antibodies on initiation and progression of prostate cancer in xenograft mouse models. Anti-238P1B2 antibodies inhibit tumor formation of both androgen-dependent and androgen-independent tumors, retard the growth of already established tumors, and prolong the survival of treated mice. Moreover, anti-238P1B2 mAbs demonstrate a dramatic inhibitory effect on the spread of local prostate tumor to distal sites, even in the presence of a large tumor burden. Thus, anti-238P1B2 mAbs are efficacious on major clinically relevant end points (tumor growth), prolongation of survival, and health.

Example 39

Therapeutic and Diagnostic Use of Anti-238P1B2 Antibodies in Humans

Anti-238P1B2 monoclonal antibodies are safely and effectively used for diagnostic, prophylactic, prognostic and/or therapeutic purposes in humans. Western blot and immunohistochemical analysis of cancer tissues and cancer xenografts with anti-238P1B2 mAb show strong extensive staining in carcinoma but significantly lower or undetectable levels in normal tissues. Detection of 238P1B2 in carcinoma and in metastatic disease demonstrates the usefulness of the mAb as a diagnostic and/or prognostic indicator. Anti-238P1B2 antibodies are therefore used in diagnostic applications such as immunohistochemistry of kidney biopsy specimens to detect cancer from suspect patients.

As determined by flow cytometry, anti-238P1B2 mAb specifically binds to carcinoma cells. Thus, anti-238P1B2 antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of 238P1B2. Shedding or release of an extracellular domain of 238P1B2 into the extracellular milieu, such as that seen for alkaline phosphodiesterase B10 (Meerson, N. R., Hepatology 27:563-568 (1998)), allows diagnostic detection of 238P1B2 by anti-238P1B2 antibodies in serum and/or urine samples from suspect patients.

Anti-238P1B2 antibodies that specifically bind 238P1B2 are used in therapeutic applications for the treatment of cancers that express 238P1B2. Anti-238P1B2 antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-238P1B2 antibodies are tested for efficacy of tumor prevention and growth inhibition in the SCID mouse cancer xenograft models, e.g., kidney cancer models AGS-K3 and AGS-K6, (see, e.g., the Example entitled "Monoclonal Antibody-mediated Inhibition of Prostate Tumors In vivo"). Conjugated and unconjugated anti-238P1B2 antibodies are used as a therapeutic modality in human clinical trials either alone or in combination with other treatments as described in the following Examples.

Example 40

Human Clinical Trials for the Treatment and Diagnosis of Human Carcinomas Through Use of Human Anti-238P1B2 Antibodies In vivo Antibodies are used in accordance with the present invention which recognize an epitope on 238P1B2, and are used in the treatment of certain tumors such as those listed in Table I. Based upon a number of factors, including 238P1B2 expression levels, tumors such as those listed in Table I are presently preferred indications. In connection with each of these indications, three clinical approaches are successfully pursued.

I.) Adjunctive therapy: In adjunctive therapy, patients are treated with anti-238P1B2 antibodies in combination with a chemotherapeutic or antineoplastic agent and/or radiation therapy. Primary cancer targets, such as those listed in Table I, are treated under standard protocols by the addition anti-238P1B2 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-238P1B2 antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

II.) Monotherapy: In connection with the use of the anti-238P1B2 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-238P1B2 antibodies, the radiolabeled antibodies are utilized as a diagnostic and/or imaging agent. In such a role, the labeled antibodies localize to both solid tumors, as well as, metastatic lesions of cells expressing 238P1B2. In connection with the use of the anti-238P1B2 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-238P1B2 antibody is used as an imaging agent in a Phase I human clinical trial in patients having a carcinoma that expresses 238P1B2 (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified Dose and Route of Administration As appreciated by those of ordinary skill in the art, dosing considerations can be determined through comparison with the analogous products that are in the clinic. Thus, anti-238P1B2 antibodies can be administered with doses in the range of 5 to 400 mg/m$^2$, with the lower doses used, e.g., in connection with safety studies. The affinity of anti-238P1B2 antibodies relative to the affinity of a known antibody for its target is one parameter used by those of skill in the art for determining analogous dose regimens. Further, anti-238P1B2 antibodies that are fully human antibodies, as compared to the chimeric antibody, have slower clearance; accordingly, dosing in patients with such fully human anti-238P1B2 antibodies can be lower, perhaps in the range of 50 to 300 mg/m$^2$, and still remain efficacious. Dosing in mg/m$^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-238P1B2 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-238P1B2 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-238P1B2 antibodies. As will be appreciated, one criteria that can be utilized in connection with enrollment of patients is 238P1B2 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 238P1B2. Standard tests and follow-up are utilized to monitor each of these safety concerns. Anti-238P1B2 antibodies are found to be safe upon human administration.

Example 41

Human Clinical Trial Adjunctive Therapy with Human Anti-238P1B2 Antibody and Chemotherapeutic Agent A phase I human clinical trial is initiated to assess the safety of six intravenous doses of a human anti-238P1B2 antibody in connection with the treatment of a solid tumor, e.g., a cancer of a tissue listed in Table I. In the study, the safety of single doses of anti-238P1B2 antibodies when utilized as an adjunctive therapy to an antineoplastic or chemotherapeutic agent, such as cisplatin, topotecan, doxorubicin, adriamycin, taxol, or the like, is assessed. The trial design includes delivery of six single doses of an anti-238P1B2 antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
| --- | --- | --- | --- | --- | --- | --- |
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 238P1B2. Standard tests and follow-up are utilized to monitor each of these safety concerns. Patients are also assessed for clinical outcome, and particularly reduction in tumor mass as evidenced by MRI or other imaging.

The anti-238P1B2 antibodies are demonstrated to be safe and efficacious, Phase II trials confirm the efficacy and refine optimum dosing.

Example 42

Human Clinical Trial: Monotherapy with Human Anti-238P1B2 Antibody

Anti-238P1B2 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-238P1B2 antibodies.

Example 43

Human Clinical Trial: Diagnostic Imaging with Anti-238P1B2 Antibody

Once again, as the adjunctive therapy discussed above is safe within the safety criteria discussed above, a human clinical trial is conducted concerning the use of anti-238P1B2 antibodies as a diagnostic imaging agent. The protocol is designed in a substantially similar manner to those described in the art, such as in Divgi et al. *J. Natl. Cancer Inst.* 83:97-104 (1991). The antibodies are found to be both safe and efficacious when used as a diagnostic modality.

Example 44

Homology Comparison of 238P1B2 to Known Sequences

The 238P1B2 gene is homologous to a cloned and sequenced gene, namely the mouse olfactory receptor MOR14-1 (gi 18479244) (Zhang X, Firestein S. Nat Neurosci. 2002, 5:124), showing 83% identity and 90% homology to that gene product (FIG. 4A; FIG. 4C). The 238P1B2 protein shows 78% identity and 87% homology to another mouse olfactory receptor, namely MOR14-10 (gi 18480766). The closest human homolog to 238P1B2 is the human olfactory receptor 5BETA12 (5I2, gi 17456801), with 61% identity and 79% homology (FIG. 4E). Comparison of 238P1B2 to another member of the human olfactory receptor family, namely 101P3A11 (reference AGS patent), the 238P1B2 protein shows 48% identity and 70% homology to 101P3A11, with the first amino acid of 238P1B2 aligning with aa 62 of 101P3A11. The 238P1B2 variant 1A protein consists of 254 amino acids, with calculated molecular weight of 28.5 kDa, and pI of 9.2. 238P1B2 is a cell surface protein with some localization to the mitochondria and endoplasmic reticulum. Three forms of the 238P1B2 protein have been identified, with variant 238P1B2 V2 containing a isoleucine to threonine point mutation at amino acid 225, and variant 238P1B2 V1B containing an additional 62 aa at its amino-terminus (FIG. 4F). While 238P1B2 V1A is projected to have 6 transmembrane domains, 238P1B2 V1B contains 7 transmembrane domains, with the N-terminus oriented extracellularly and the C-terminus being intracellular (Table XXII, FIG. 13).

Motif analysis revealed the presence of several known motifs, including a 7 transmembrane olfactory receptor GPCR motif and a fibronectin Type III repeat. Proteins that are members of the G-protein coupled receptor family exhibit an extracellular amino-terminus, three extracellular loops, three intracellular loops and an intracellular carboxyl terminus. G-protein coupled receptors are seven-transmembrane receptors that are stimulated by polypeptide hormones, neurotransmitters, chemokines and phospholipids (Civelli O et al, Trends Neurosci. 2001, 24:230; Vrecl M et al., Mol Endocrinol. 1998, 12:1818). Ligand binding traditionally occurs between the first and second extracellular loops of the GPCR. Upon ligand binding GPCRs transduce signals across the cell surface membrane by associating with trimeric G proteins. Their signals are transmitted via trimeric guanine-nucleotide binding proteins (G proteins) to cell surface receptor, effector enzymes or ion channels (Simon et al., 1991, Science 252: 802). Signal transduction and biological output mediated by GPCR can be modulated through various mechanisms including peptide mimics, small molecule inhibitors and GPCR kinases or GRK (Pitcher J A et al, J Biol Chem. 1999, 3; 274:34531; Fawzi A B, et al. 2001, Mol. Pharmacol., 59:30).

Recently, GPCRs have also been shown to link to mitogenic signaling pathways of tyrosine kinases (Luttrell et al., 1999, Science 283: 655; Luttrell et al., 1999 Curr Opin Cell Biol 11: 177). GPCRs are regulated by phosphorylation mediated by GPCR kinases (GRKs), which themselves are indirectly activated by the GPCRs (Pitcher et al., 1998, Ann. Rev. Biochem. 67: 653). Olfactory GPCRs transmit their signals by activating the cAMP pathway via adenylate cyclase resulting in downstream signaling to protein kinase A, and by activating the phospholipase C pathway by generating inositol 1,4,5-trisphosphate (IP3) and diacylglycerol (DAG) (Breer, 1993, Ciba Found Symp 179: 97; Bruch, 1996, Comp Biochem Physiol B Biochem Mol Biol 113:451). IP3 results in an increase in intracellular calcium, while DAG activates protein kinase C.

Recent studies have associated GPCRs with cellular transformation. In particular, KSHV G protein-coupled receptor was found to transform NIH 3T3 cells in vitro and induces multifocal KS-like lesions in KSHV-GPCR-transgenic mice (Schwarz M, Murphy P M. J Immunol 2001, 167:505). KSHV-GPCR was capable of producing its effect on endothelial cells and fibroblasts by activating defined signaling pathways, including the AKT survival pathway (Montaner S et al, Cancer Res 2001, 61:2641). In addition, KSHV-GPCR induced the activation of mitogenic pathways such as AP-1 and NFkB, resulting in the expression of pro-inflammatory genes (Schwarz M, Murphy P M. J Immunol 2001, 167:505). Other GPCRs associated with tumor formation include G2A, and PAR-1, which has been found to induce transformation of NIH 3T3 cells (Whitehead IP et al, Oncogene 2001, 20:1547).

Fibronectin repeat regions are motifs that mediate binding to a variety of substances such as heparin, collagen, fibrin and fibronectin receptors on cell surfaces. Due to their binding capacity fibronectins are involved in cell adhesion, cell differentiation, spreading, migration, and tumor metastasis (Nykvist P et al, J Biol Chem 2001, 276:38673; Danen E H, Yamada K M. J Cell Physiol 2001, 189:1; Nabeshima K et al, Histol Histopathol 1999, 14:1183). In addition, fibronectin enhances angiogenesis and de novo blood vessel formation by regulating the migration of endothelial cells, which constitute essential components of blood vessels (Urbich C et al, Arterioscler Thromb Vasc Biol 2002, 22:69), thereby enhancing tumor growth and survival.

This information indicates that 238P1B2 plays a role in the transformation of mammalian cells, induces mitogenic responses including activation of various signaling pathways, and regulates gene transcription by transmitting cell surface signals to the nucleus. Accordingly, when 238P1B2 functions as a regulator of cell transformation, tumor formation, or as a modulator of transcription involved in activating genes associated with inflammation, tumorigenesis or proliferation, 238P1B2 is used for therapeutic, diagnostic, prognostic and/or preventative purposes. In addition, when a molecule, such as a variant or polymorphism of 238P1B2 is expressed in cancerous tissues, it is used for therapeutic, diagnostic, prognostic and/or preventative purposes.

Example 45

Identification and Confirmation of Potential Signal Transduction Pathways

Many mammalian proteins have been reported to interact with signaling molecules and to participate in regulating signaling pathways. (J Neurochem. 2001; 76:217-223). In particular, GPCRs have been reported to activate MAK cascades as well as G proteins, and have been associated with the EGFR pathway in epithelial cells (Naor, Z., et al, Trends Endocrinol Metab. 2000, 11:91; Vacca F et al, Cancer Res. 2000, 60:5310; Della Rocca G J et al, J Biol Chem. 1999, 274:13978). Using immunoprecipitation and Western blotting techniques, proteins are identified that associate with 238P1B2 and mediate signaling events. Several pathways known to play a role in cancer biology can be regulated by 238P1B2, including phospholipid pathways such as P13K, AKT, etc.; adhesion and migration pathways, including FAK, Rho, Rac-1, etc.; and mitogenic/survival cascades such as ERK, p38, etc. (Cell Growth Differ. 2000, 11:279; J Biol Chem. 1999, 274:801; Oncogene. 2000, 19:3003, J. Cell Biol. 1997, 138:913).

Several GPCRs have been shown to transactivate receptor tyrosine kinases associated with the cell membrane, such as the EGF receptor (EGFR) (Pierce K L et al, J Biol Chem. 2001, 276:23155; Nath D et al, J Cell Sci. 2001, 114:1213). In order to determine whether 238P1B2 signaling results in the activation of EGFR, cells are grown in media alone or in the presence of the EGFR inhibitor AG1517. EGFR phosphorylation is compared in control and treated cells. Similarly, cross talk between 238P1B2 and EGFR pathways is investigated.

To confirm that 238P1B2 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 238P1B2 are mapped and used for the identification and validation of therapeutic targets. When 238P1B2 is involved in cell signaling, it is used as target for diagnostic, prognostic, preventative and/or therapeutic purposes.

Example 46

238P1B2 Functions as a GPCR

Sequence and homology analysis of 238P1B2 indicate that the 238P1B2 protein is a member of the olfactory receptor family of GPCR. Olfactory receptors are known to regulate biological responses by activating adenylate cyclase. In order to confirm that 238P1B2 functions as a GPCR and mediates the activation of adenylate cyclase, cAMP accumulation in PC3 and PC3-238P1B2 cells are compared in cells grown in the presence or absence of fetal bovine serum (FBS). The cells are lysed and intracellular concentration of cAMP are measured using a commercially available enzyme immunoassay (EIA). Calculations of cAMP concentrations were based on OD450 of the standard curve. Similarly, the same assay can be used to determine whether the induction of cAMP accumulation by 238P1B2 is inhibited by GPCR inhibitors such as pertussis toxin.

GPCR transmit their signal by activating trimeric G proteins. Once GPCRs are activated, the associated Ga subunit binds GTP, dissociates from the receptor and participates in downstream signaling events (Schild D and Restrepo D. Physiol Rev. 1998, 78:429-66). In order to determine that inhibition of Ga subunits has an effect on 238P1B2 mediated cell growth, the effect of Ga inhibitors on the proliferation of 3T3-238P1B2 and PC3-238P1B2 cells is investigated. Control and 238P1B2-expressing cells are grown in the presence or absence of suramin or its derivative NF 449 (Sigma). Cells are analyzed for proliferation using an MTT-like assay.

When 238P1B2 functions as a GPCR, it is used as target for diagnostic, prognostic, preventative and/or therapeutic purposes.

Example 47

Involvement in Tumor Progression

The 238P1B2 gene can contribute to the growth of cancer cells. The role of 238P1B2 in tumor growth is confirmed in a variety of primary and transfected cell lines including prostate as well as NIH 3T3 cells engineered to stably express 238P1B2. Parental cells lacking 238P1B2 and cells expressing 238P1B2 are evaluated for cell growth using a well-documented proliferation assay (Fraser S P, Grimes J A, Djamgoz M B. Prostate. 2000; 44:61, Johnson D E, Ochieng J, Evans S L. Anticancer Drugs. 1996, 7:288). To confirm that 238P1B2 mediates enhanced proliferation by way of its GPCR activity, control cells and cells expressing 238P1B2 are grown in the presence or absence of pertussis toxin, and evaluated for their proliferative capability using the same assay described above.

To confirm the role of 238P1B2 in the transformation process, its effect in colony forming assays is investigated. Parental NIH-3T3 cells lacking 238P1B2 are compared to NIH-3T3 cells expressing 238P1B2, using a soft agar assay under stringent and more permissive conditions (Song Z. et al., Cancer Res. (2000) 60:6730).

To confirm the role of 238P1B2 in invasion and metastasis of cancer cells, a well-established assay is used, e.g., a Transwell Insert System assay (Becton Dickinson) (Cancer Res. 1999; 59:6010). Control cells, including prostate and fibroblast cell lines lacking 238P1B2 are compared to cells expressing 238P1B2. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

238P1B2 can also play a role in cell cycle and apoptosis. Parental cells and cells expressing 238P1B2 are compared for differences in cell cycle regulation using a well-established BrdU assay (Abdel-Malek Z A. J Cell Physiol. 1988, 136:247). In short, cells grown under both optimal (full serum)

and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 238P1B2, including normal and tumor prostate cells. Engineered and parental cells are treated with various chemotherapeutic agents, such as etoposide, flutamide, etc, and protein synthesis inhibitors, such as cycloheximide. Cells are stained with annexin V-FITC and cell death is measured by FACS analysis. The modulation of cell death by 238P1B2 can play a critical role in regulating tumor progression and tumor load.

When 238P1B2 plays a role in cell growth, transformation, invasion or apoptosis, it is used as a target for diagnostic, prognostic, preventative and/or therapeutic purposes.

Example 48

Involvement in Angiogenesis

Angiogenesis or new capillary blood vessel formation is necessary for tumor growth (Hanahan D, Folkman J. Cell. 1996, 86:353; Folkman J. Endocrinology. 1998 139:441). Based on the effect of phsophodiesterase inhibitors on endothelial cells, 238P1B2 plays a role in angiogenesis (DeFouw L et al, Microvasc Res 2001, 62:263). Several assays have been developed to measure angiogenesis in vitro and in vivo, such as the tissue culture assays of endothelial cell tube formation and endothelial cell proliferation. Using these assays as well as in vitro neo-vascularization, the role of 238P1B2 in angiogenesis, enhancement or inhibition, is confirmed.

For example, endothelial cells engineered to express 238P1B2 are evaluated using tube formation and proliferation assays. The effect of 238P1B2 is also confirmed in animal models in vivo. For example, cells either expressing or lacking 238P1B2 are implanted subcutaneously in immunocompromised mice. Endothelial cell migration and angiogenesis are evaluated 5-15 days later using immunohistochemistry techniques. 238P1B2 affects angiogenesis, and it is used as a target for diagnostic, prognostic, preventative and/or therapeutic purposes

Example 49

Regulation of Transcription

The cell surface localization of 238P1B2 and its similarity to GPCRs indicate that 238P1B2 is effectively used as a modulator of the transcriptional regulation of eukaryotic genes. Regulation of gene expression is confirmed, e.g., by studying gene expression in cells expressing or lacking 238P1B2. For this purpose, two types of experiments are performed.

In the first set of experiments, RNA from parental and 238P1B2-expressing cells are extracted and hybridized to commercially available gene arrays (Clontech) (Smid-Koopman E et al. Br J Cancer. 2000. 83:246). Resting cells as well as cells treated with FBS or androgen are compared. Differentially expressed genes are identified in accordance with procedures known in the art. The differentially expressed genes are then mapped to biological pathways (Chen K et al. Thyroid. 2001. 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, 238P1B2 plays a role in gene regulation, and it is used as a target for diagnostic, prognostic, preventative and/or therapeutic purposes.

Example 50

Involvement in Cell Adhesion

Cell adhesion plays a critical role in tissue colonization and metastasis. Based on the presence of a fibronectin repeat in its C-terminus, 238P1B2 can participate in cellular organization, and as a consequence affects cell adhesion and motility. To confirm that 238P1B2 regulates cell adhesion, control cells lacking 238P1B2 are compared to cells expressing 238P1B2, using techniques previously described (see, e.g., Haier et al, Br. J. Cancer. 1999, 80:1867; Lehr and Pienta, J. Natl. Cancer Inst. 1998, 90:118). Briefly, in one embodiment, cells labeled with a fluorescent indicator, such as calcein, are incubated on tissue culture wells coated with media alone or with matrix proteins. Adherent cells are detected by fluorimetric analysis and percent adhesion is calculated. In another embodiment, cells lacking or expressing 238P1B2 are analyzed for their ability to mediate cell-cell adhesion using similar experimental techniques as described above. Both of these experimental systems are used to identify proteins, antibodies and/or small molecules that modulate cell adhesion to extracellular matrix and cell-cell interaction. Cell adhesion plays a critical role in tumor growth, progression, and colonization, and 238P1B2 is involved in these processes. Thus, it serves as a diagnostic, prognostic, preventative and/or therapeutic modality.

Example 51

Protein-Protein Association

Several GPCRs have been shown to interact with other proteins, thereby regulating signal transduction, gene transcription, transformation and cell adhesion (Sexton P M et al, Cell Signal. 2001, 13:73; Turner C E, J Cell Sci. 2000, 23:4139). Using immunoprecipitation techniques as well as two yeast hybrid systems, proteins are identified that associate with 238P1B2. Immunoprecipitates from cells expressing 238P1B2 and cells lacking 238P1B2 are compared for specific protein-protein associations.

Studies are performed to confirm the extent of association of 238P1B2 with effector molecules, such as nuclear proteins, transcription factors, kinases, phosphates etc. Studies comparing 238P1B2 positive and 238P1B2 negative cells as well as studies comparing unstimulated/resting cells and cells treated with epithelial cell activators, such as cytokines, growth factors, androgen and anti-integrin Ab reveal unique interactions.

In addition, protein-protein interactions are confirmed using two yeast hybrid methodology (Curr Opin Chem Biol. 1999, 3:64). A vector carrying a library of proteins fused to the activation domain of a transcription factor is introduced into yeast expressing a 238P1B2-DNA-binding domain fusion protein and a reporter construct. Protein-protein interaction is detected by colorimetric reporter activity. Specific association with effector molecules and transcription factors directs one of skill to the mode of action of 238P1B2, and thus identifies therapeutic, prognostic, preventative and/or diagnostic targets for cancer. This and similar assays are also used to identify and screen for small molecules that interact with 238P1B2.

Thus it is found that 238P1B2 associates with proteins and small molecules. Accordingly, 238P1B2 and these proteins and small molecules are used for diagnostic, prognostic, preventative and/or therapeutic purposes.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

Tables:

TABLE I

Tissues that Express 238P1B2 When Malignant

Prostate

TABLE II

AMINO ACID ABBREVIATIONS

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE IV (A)

| | POSITION 2 (Primary Anchor) | POSITION 3 (Primary Anchor) | POSITION C Terminus (Primary Anchor) |
|---|---|---|---|
| SUPERMOTIFS | | | |
| A1 | TI*LVMS* | | FWY |
| A2 | LIVM*ATQ* | | IV*MATL* |
| A3 | VSMA*TLI* | | RK |
| A24 | YF*WIVLMT* | | FI*YWLM* |
| B7 | P | | VILF*MWYA* |
| B27 | RHK | | FYL*WMIVA* |
| B44 | ED | | FWYLIMVA |
| B58 | ATS | | FWY*LIVMA* |
| B62 | QL*IVMP* | | FWYMIVLA |
| MOTIFS | | | |
| A1 | TSM | | Y |
| A1 | | DE*AS* | Y |
| A2.1 | LM*VQIAT* | | V*LIMAT* |
| A3 | LMVISATF*CGD* | | KYR*HFA* |
| A11 | VTMLISAGN*CDF* | | KR*YH* |
| A24 | YF*WM* | | FLIW |
| A*3101 | MVT*ALIS* | | RK |
| A*3301 | MVALF*IST* | | RK |
| A*6801 | AVT*MSLI* | | RK |
| B*0702 | P | | LMFW*YAIV* |
| B*3501 | P | | LMFWY*IVA* |
| B51 | P | | LIVF*WYAM* |
| B*5301 | P | | IMFWY*ALV* |
| B*5401 | P | | ATIV*LMFWY* |

Bolded residues are preferred, italicized residues are less preferred: A peptide is considered motif-bearing if it has primary anchors at each primary anchor position for a motif or supermotif as specified in the above table.

TABLE IV (B)

| HLA CLASS II SUPERMOTIF | | |
|---|---|---|
| 1 | 6 | 9 |
| W, F, Y, V, .I, L | A, V, I, L, P, C, S, T | A, V, I, L, C, S, T, M, Y |

TABLE III

AMINO ACID SUBSTITUTION MATRIX
Adapted from the GCG Software 9.0 BLOSUM62 amino acid substitution matrix (block substitution matrix). The higher the value, the more likely a substitution is found in related, natural proteins.

| A | C | D | E | F | G | H | I | K | L | M | N | P | Q | R | S | T | V | W | Y | |
|---|---|---|---|---|---|---|---|---|---|---|---|---|---|---|---|---|---|---|---|---|
| 4 | 0 | −2 | −1 | −2 | 0 | −2 | −1 | −1 | −1 | −1 | −2 | −1 | −1 | −1 | 1 | 0 | 0 | −3 | −2 | A |
| | 9 | −3 | −4 | −2 | −3 | −3 | −1 | −3 | −1 | −1 | −3 | −3 | −3 | −3 | −1 | −1 | −1 | −2 | −2 | C |
| | | 6 | 2 | −3 | −1 | −1 | −3 | −1 | −4 | −3 | 1 | −1 | 0 | −2 | 0 | −1 | −3 | −4 | −3 | D |
| | | | 5 | −3 | −2 | 0 | −3 | 1 | −3 | −2 | 0 | −1 | 2 | 0 | 0 | −1 | −2 | −3 | −2 | E |
| | | | | 6 | −3 | −1 | 0 | −3 | 0 | 0 | −3 | −4 | −3 | −3 | −2 | −2 | −1 | 1 | 3 | F |
| | | | | | 6 | −2 | −4 | −2 | −4 | −3 | 0 | −2 | −2 | −2 | 0 | −2 | −3 | −2 | −3 | G |
| | | | | | | 8 | −3 | −1 | −3 | −2 | 1 | −2 | 0 | 0 | −1 | −2 | −3 | −2 | 2 | H |
| | | | | | | | 4 | −3 | 2 | 1 | −3 | −3 | −3 | −3 | −2 | −1 | 3 | −3 | −1 | I |
| | | | | | | | | 5 | −2 | −1 | 0 | −1 | 1 | 2 | 0 | −1 | −2 | −3 | −2 | K |
| | | | | | | | | | 4 | 2 | −3 | −3 | −2 | −2 | −2 | −1 | 1 | −2 | −1 | L |
| | | | | | | | | | | 5 | −2 | −2 | 0 | −1 | −1 | −1 | 1 | −1 | −1 | M |
| | | | | | | | | | | | 6 | −2 | 0 | 0 | 1 | 0 | −3 | −4 | −2 | N |
| | | | | | | | | | | | | 7 | −1 | −2 | −1 | −1 | −2 | −4 | −3 | P |
| | | | | | | | | | | | | | 5 | 1 | 0 | −1 | −2 | −2 | −1 | Q |
| | | | | | | | | | | | | | | 5 | −1 | −1 | −3 | −3 | −2 | R |
| | | | | | | | | | | | | | | | 4 | 1 | −2 | −3 | −2 | S |
| | | | | | | | | | | | | | | | | 5 | 0 | −2 | −2 | T |
| | | | | | | | | | | | | | | | | | 4 | −3 | −1 | V |
| | | | | | | | | | | | | | | | | | | 11 | 2 | W |
| | | | | | | | | | | | | | | | | | | | 7 | Y |

TABLE IV (C)

HLA Class II Motifs

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | | I | VST*CPALIM* | MH | | MH |
| | deleterious | | | | W | | | R | | WDE |
| DR1 | preferred | MF*LIVWY* | | | PAMQ | | VMAT*SPLIC* | M | | AVM |
| | deleterious | | C | CH | FD | CWD | | GDE | D | |
| DR7 | preferred | MF*LIVWY* | M | W | A | | IVMSA*CTPL* | M | | IV |
| | deleterious | | C | | G | | | GRD | N | G |

| DR3 | MOTIFS | 1° anchor 1 | 2 | 3 | 1° anchor 4 | 5 | 1° anchor 6 | | | |
|---|---|---|---|---|---|---|---|---|---|---|
| motif a preferred | | LIVMFY | | | D | | | | | |
| motif b preferred | | LIVMFAY | | | DNQEST | | KRH | | | |
| DR Supermotif | | MF*LIVWY* | | | | | VMSTA*CPLI* | | | |

Italicized residues indicate less preferred or "tolerated" residues

TABLE IV (D)

HLA Class I Supermotifs

| SUPER-MOTIFS | | POSITION: 1 | 2 | 3 | 4 | 5 | 6 | 7 | 8 | C-terminus |
|---|---|---|---|---|---|---|---|---|---|---|
| A1 | | | 1° Anchor TI*LVMS* | | | | | | | 1° Anchor FWY |
| A2 | | | 1° Anchor LIVM*ATQ* | | | | | | | 1° Anchor LIVMAT |
| A3 | preferred | | 1° Anchor VSMA*TLI* | YFW (4/5) | | | YFW (3/5) | YFW (4/5) | P (4/5) | 1° Anchor RK |
| | deleterious | DE (3/5); P (5/5) | | DE (4/5) | | | | | | |
| A24 | | | 1° Anchor YF*WIVLMT* | | | | | | | 1° Anchor FIY*WLM* |
| B7 | preferred | FWY (5/5) LIVM (3/5) | 1° Anchor P | FWY (4/5) | | | | | FWT (3/5) | 1° Anchor VILF*MWYA* |
| | deleterious | DE (3/5); P(5/5); G(4/5); A(3/5); QN(3/5) | | | | DE (3/5) | G (4/5) | QN (4/5) | (DE) (4/5) | |
| B27 | | | 1° Anchor RHK | | | | | | | 1° Anchor FYL*WMIVA* |
| B44 | | | 1° Anchor E*D* | | | | | | | 1° Anchor FWYLIMVA |
| B58 | | | 1° Anchor ATS | | | | | | | 1° Anchor FWY*LIVMA* |
| B62 | | | 1° Anchor QL*IVMP* | | | | | | | 1° Anchor FWY*MIVLA* |

TABLE IV (E)

HLA Class I Motifs

| | | POSITION: 1 | 2 | 3 | 4 | 5 | 6 | 7 | 8 | 9 | C-terminus |
|---|---|---|---|---|---|---|---|---|---|---|---|
| A1 9-mer | preferred | GFYW | 1° Anchor STM | DEA | YFW | | P | DEQN | YFW | or C-terminus 1° Anchor Y | |
| | deleterious | DE | | | RHKL IVMP | A | G | A | | | |
| A1 9-mer | preferred | GRHK | ASTC LIVM | 1° Anchor DEAS | GSTC | | ASTC | LIVM | DE | 1° Anchor Y | |
| | deleterious | A | RHKDEPY FW | | DE | PQN | RHK | PG | GP | | |

TABLE IV (E)-continued

HLA Class I Motifs

| | | 1 | 2 | 3 | 4 | 5 | 6 | 7 | 8 | 9 | C-terminus |
|---|---|---|---|---|---|---|---|---|---|---|---|
| A1 10-mer | preferred | YFW | 1° Anchor STM | DEAQN | A | YFWQN | | PASTC | GDE | P | 1° Anchor Y |
| | deleterious | GP | | RHKG LIVM | DE | RHK | QNA | RHKY FW | RHK | A | |
| A1 10-mer | preferred | YFW | STCL IVM | 1° Anchor DE*AS* | A | YFW | | PG | G | YFW | 1° Anchor Y |
| | deleterious | RHK | RHKD EPY FW | | | P | G | | PRHK | QN | |
| A2.1 9-mer | preferred | YFW | 1° Anchor LM*IVQAT* | YFW | STC | YFW | | A | P | | 1° Anchor V*LIMAT* |
| | deleterious | DEP | | DERKH | | | RKH | DERKH | | | |
| A2.1 10-mer | preferred | AYFW | 1° Anchor LM*IVQAT* | LVIM | G | | *G* | | FYWL VIM | | 1° Anchor LM*IVQAT* |
| | deleterious | DEP | | DE | RKHA | P | | RKH | DERKH | RKH | |
| A3 | preferred | RHK | 1° Anchor LMVISA TFCGD | YFW | PRHK YFW | A | YFW | | P | 1° Anchor KYR*HFA* | |
| | deleterious | DEP | | DE | | | | | | | |
| A11 | preferred | A | 1° Anchor VTLMIS AGN*CDF* | YFW | YFW | A | YFW | YFW | P | 1° Anchor K*RYH* | |
| | deleterious | DEP | | | | | | A | G | | |
| A24 9-mer | preferred | YFWRHK | 1° Anchor YFW*M* | | STC | | | YFW | YFW | 1° Anchor FLIW | |
| | deleterious | DEG | | DE | G | QNP | DERHK | G | AQN | | |
| A24 10-mer | preferred | | 1° Anchor YFW*M* | | P | YFWP | | P | | | 1° Anchor FLIW |
| | deleterious | | | GDE | QN | RHK | DE | A | QN | DEA | |
| A3101 | preferred | RHK | 1° Anchor MVT*ALIS* | YFW | P | | YFW | YFW | AP | 1° Anchor R*K* | |
| | deleterious | DEP | | DE | | ADE | DE | DE | DE | | |
| A3301 | preferred | | 1° Anchor MVALF*I ST* | YFW | | | | AYFW | | 1° Anchor R*K* | |
| | deleterious | GP | | DE | | | | | | | |
| A6801 | preferred | YFWSTC | 1° Anchor AVT*MSLI* | | | YFWL IVM | | YFW | P | 1° Anchor R*K* | |
| | deleterious | GP | | DEG | | RHK | | | A | | |
| B0702 | preferred | RHKFW Y | 1° Anchor P | RHK | | RHK | RHK | RHK | PA | 1° Anchor LMF*WYAIV* | |
| | deleterious | DEQNP | | DEP | DE | DE | GDE | QN | DE | | |
| B3501 | preferred | FWYLIV M | 1° Anchor P | FWY | DE | DE | | FWY | | 1° Anchor LMGWY*IV A* | |
| | deleterious | AGP | | | | G | G | | | | |
| B51 | preferred | LIVMFW Y | 1° Anchor P | FWY | STC | FWY | | G | FWY | 1° Anchor LIVF *WYAM* | |
| | deleterious | AGPDER HKSTC | | | | DE | G | DEQN | GDE | | |
| B5301 | preferred | LIVMFW Y | 1° Anchor P | FWY | STC | FWY | | LIVM FWY | FWY | 1° Anchor IMFWY*AL V* | |
| | deleterious | AGPQN | | | | | G | RHKQN | DE | | |
| B5401 | preferred | FWY | 1° Anchor P | FWYL IVM | | LIVM | | ALIVM | FWYAP | 1° Anchor ATIV*LMF WY* | |
| | deleterious | GPQNDE | | GDES TC | | RHKDE | DE | QNDGE | DE | | |

Italicized residues indicate less preferred or "tolerated" residues. The information in this Table is specific for 9-mers unless otherwise specified.

TABLE V

V1-A1-9mers: 238P1B2

| Pos | 123456789 | Score | SEQ ID |
|---|---|---|---|
| 152 | DLLLILLSY | 2.500 | 19. |
| 66 | VAVSNPLRY | 2.500 | 20. |
| 150 | GVDLLLILL | 2.500 | 21. |
| 78 | LTDSRIAQI | 2.500 | 22. |
| 102 | VALLIRLSY | 2.500 | 23. |
| 186 | HIVAFAIYY | 2.500 | 24. |
| 172 | SPEERKETF | 2.250 | 25. |
| 51 | VMESSVLLA | 2.250 | 26. |
| 200 | LSIVHRFGK | 1.500 | 27. |
| 10 | ATDLGLSIS | 1.250 | 28. |
| 21 | VTMLSIFWF | 1.250 | 29. |
| 131 | CTDTRINSA | 1.250 | 30. |
| 39 | CLSHMFFIK | 1.000 | 31. |
| 114 | QVLHHSYCY | 1.000 | 32. |
| 40 | LSHMFFIKF | 0.750 | 33. |
| 112 | HSQVLHHSY | 0.750 | 34. |
| 54 | SSVLLAMAF | 0.750 | 35. |
| 123 | HPDVMKLSC | 0.625 | 36. |
| 37 | NACLSHMFF | 0.500 | 37. |
| 56 | VLLAMAFDR | 0.500 | 38. |
| 157 | LLSYVLIIR | 0.500 | 39. |
| 120 | YCYHPDVMK | 0.400 | 40. |
| 68 | VSNPLRYAM | 0.300 | 41. |
| 226 | SPLMNPVIY | 0.250 | 42. |
| 65 | FVAVSNPLR | 0.200 | 43. |
| 85 | QIGVASVIR | 0.200 | 44. |
| 197 | LISLSIVHR | 0.200 | 45. |
| 97 | MLTPMVALL | 0.200 | 46. |
| 138 | SAVGLTAMF | 0.200 | 47. |
| 182 | TCVSHIVAF | 0.200 | 48. |
| 169 | SVASPEERK | 0.200 | 49. |
| 168 | LSVASPEER | 0.150 | 50. |
| 198 | ISLSIVHRF | 0.150 | 51. |
| 24 | LSIFWFNVR | 0.150 | 52. |
| 18 | STLVTMLSI | 0.125 | 53. |
| 99 | TPMVALLIR | 0.125 | 54. |
| 98 | LTPMVALLI | 0.125 | 55. |

TABLE V-continued

V1-A1-9mers: 238P1B2

| Pos | 123456789 | Score | SEQ ID |
|---|---|---|---|
| 181 | STCVSHIVA | 0.125 | 56. |
| 147 | STVGVDLLL | 0.125 | 57. |
| 224 | LISPLMNPV | 0.100 | 58. |
| 19 | TLVTMLSIF | 0.100 | 59. |
| 57 | LLAMAFDRF | 0.100 | 60. |
| 74 | YAMILTDSR | 0.100 | 61. |
| 228 | LMNPVIYSV | 0.100 | 62. |
| 158 | LSYVLIIRT | 0.075 | 63. |
| 89 | ASVIRGLLM | 0.075 | 64. |
| 184 | VSHIVAFAI | 0.075 | 65. |
| 17 | ISTLVTMLS | 0.075 | 66. |
| 34 | ISFNACLSH | 0.075 | 67. |
| 77 | ILTDSRIAQ | 0.050 | 68. |
| 9 | SATDLGLSI | 0.050 | 69. |
| 217 | MIANTYLLI | 0.050 | 70. |
| 110 | YCHSQVLHH | 0.050 | 71. |
| 185 | SHIVAFAIY | 0.050 | 72. |
| 191 | AIYYIPLIS | 0.050 | 73. |
| 235 | SVKTKQIRR | 0.050 | 74. |
| 222 | YLLISPLMN | 0.050 | 75. |
| 130 | SCTDTRINS | 0.050 | 76. |
| 20 | LVTMLSIFW | 0.050 | 77. |
| 14 | GLSISTLVT | 0.050 | 78. |
| 38 | ACLSHMFFI | 0.050 | 79. |
| 23 | MLSIFWFNV | 0.050 | 80. |
| 194 | YIPLISLSI | 0.050 | 81. |
| 7 | MLSATDLGL | 0.050 | 82. |
| 95 | LLMLTPMVA | 0.050 | 83. |
| 148 | TVGVDLLLI | 0.050 | 84. |
| 229 | MNPVIYSVK | 0.050 | 85. |
| 156 | ILLSYVLII | 0.050 | 86. |
| 139 | AVGLTAMFS | 0.050 | 87. |
| 218 | IANTYLLIS | 0.050 | 88. |
| 243 | RAVIKILHS | 0.050 | 89. |
| 178 | ETFSTCVSH | 0.050 | 90. |
| 176 | RKETFSTCV | 0.045 | 91. |
| 31 | VREISFNAC | 0.045 | 92. |

TABLE V-continued

V1-A1-9mers: 238P1B2

| Pos | 123456789 | Score | SEQ ID |
|---|---|---|---|
| 15 | LSISTLVTM | 0.030 | 93. |
| 208 | KQAPAYVHT | 0.030 | 94. |
| 53 | ESSVLLAMA | 0.030 | 95. |
| 225 | ISPLMNPVI | 0.030 | 96. |
| 118 | HSYCYHPDV | 0.030 | 97. |
| 215 | HTMIANTYL | 0.025 | 98. |
| 142 | LTAMFSTVG | 0.025 | 99. |
| 49 | FTVMESSVL | 0.025 | 100. |
| 220 | NTYLLISPL | 0.025 | 101. |
| 42 | HMFFIKFFT | 0.025 | 102. |
| 28 | WFNVREISF | 0.025 | 103. |
| 59 | AMAFDRFVA | 0.025 | 104. |
| 214 | VHTMIANTY | 0.025 | 105. |
| 36 | FNACLSHMF | 0.025 | 106. |
| 121 | CYHPDVMKL | 0.025 | 107. |
| 213 | YVHTMIANT | 0.020 | 108. |
| 143 | TAMFSTVGV | 0.020 | 109. |
| 50 | TVMESSVLL | 0.020 | 110. |
| 83 | IAQIGVASV | 0.020 | 111. |
| 161 | VLIIRTVLS | 0.020 | 112. |
| 231 | PVIYSVKTK | 0.020 | 113. |
| 60 | MAFDRFVAV | 0.020 | 114. |
| 183 | CVSHIVAFA | 0.020 | 115. |
| 154 | LLILLSYVL | 0.020 | 116. |
| 187 | IVAFAIYYI | 0.020 | 117. |
| 244 | AVIKILHSK | 0.020 | 118. |

TABLE V

V1B-A1-9mers: 238P1B2

| Pos | 123456789 | Score | SEQ ID |
|---|---|---|---|
| 23 | GLEAFHTWI | 0.900 | 119. |
| 59 | LHEPMYYFL | 0.900 | 120. |
| 31 | ISIPFCFLS | 0.750 | 121. |
| 8 | NITSTSIIF | 0.500 | 122. |
| 43 | LLGNSLILF | 0.500 | 123. |
| 57 | PSLHEPMYY | 0.375 | 124. |

TABLE V-continued

V1B-A1-9mers: 238P1B2

| Pos | 123456789 | Score | SEQ ID |
|---|---|---|---|
| 56 | QPSLHEPMY | 0.250 | 125. |
| 19 | TGVPGLEAF | 0.250 | 126. |
| 58 | SLHEPMYYF | 0.200 | 127. |
| 9 | ITSTSIIFL | 0.125 | 128. |
| 18 | LTGVPGLEA | 0.125 | 129. |
| 11 | STSIIFLLT | 0.125 | 130. |
| 3 | TSTLQNITS | 0.075 | 131. |
| 10 | TSTSIIFLL | 0.075 | 132. |
| 38 | LSVTALLGN | 0.075 | 133. |
| 12 | TSIIFLLTG | 0.075 | 134. |
| 37 | FLSVTALLG | 0.050 | 135. |
| 32 | SIPFCFLSV | 0.050 | 136. |
| 25 | EAFHTWISI | 0.050 | 137. |
| 48 | LILFATITQ | 0.050 | 138. |
| 42 | ALLGNSLIL | 0.050 | 139. |
| 46 | NSLILFATI | 0.030 | 140. |
| 27 | FHTWISIPF | 0.025 | 141. |
| 4 | STLQNITST | 0.025 | 142. |
| 54 | ITQPSLHEP | 0.025 | 143. |
| 40 | VTALLGNSL | 0.025 | 144. |
| 2 | ITSTLQNIT | 0.025 | 145. |
| 52 | ATITQPSLH | 0.025 | 146. |
| 29 | TWISIPFCF | 0.025 | 147. |
| 20 | GVPGLEAFH | 0.020 | 148. |
| 51 | FATITQPSL | 0.020 | 149. |
| 16 | FLLTGVPGL | 0.020 | 150. |
| 61 | EPMYYFLSM | 0.013 | 151. |
| 21 | VPGLEAFHT | 0.013 | 152. |
| 45 | GNSLILFAT | 0.013 | 153. |
| 44 | LGNSLILFA | 0.013 | 154. |
| 13 | SIIFLLTGV | 0.010 | 155. |
| 1 | FITSTLQNI | 0.010 | 156. |
| 35 | FCFLSVTAL | 0.010 | 157. |
| 47 | SLILFATIT | 0.010 | 158. |
| 41 | TALLGNSLI | 0.010 | 159. |
| 39 | SVTALLGNS | 0.010 | 160. |
| 30 | WISIPFCFL | 0.010 | 161. |

TABLE V-continued

V1B-A1-9mers: 238P1B2

| Pos | 123456789 | Score | SEQ ID |
|---|---|---|---|
| 5 | TLQNITSTS | 0.010 | 162. |
| 53 | TTTQPSLHE | 0.005 | 163. |
| 28 | HTWISIPFC | 0.005 | 164. |
| 60 | HEPMYYFLS | 0.003 | 165. |
| 33 | IPFCFLSVT | 0.003 | 166. |
| 7 | QNITSTSII | 0.003 | 167. |
| 55 | TQPSLHEPM | 0.002 | 168. |
| 6 | LQNITSTSI | 0.002 | 169. |
| 14 | IIFLLTGVP | 0.001 | 170. |
| 36 | CFLSVTALL | 0.001 | 171. |
| 49 | ILFATITQP | 0.001 | 172. |
| 15 | IFLLTGVPG | 0.001 | 173. |
| 17 | LLTGVPGLE | 0.001 | 174. |
| 50 | LFATITQPS | 0.001 | 175. |
| 62 | PMYYFLSML | 0.001 | 176. |
| 24 | LEAFHTWIS | 0.001 | 177. |
| 22 | PGLEAFHTW | 0.000 | 178. |
| 34 | PFCFLSVTA | 0.000 | 179. |
| 26 | AFHTWISTI | 0.000 | 180. |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE V

V2-A1-9mers: 238P1B2

| Pos | 123456789 | Score | SEQ ID |
|---|---|---|---|
| 8 | LTSPLMNPV | 0.250 | 181. |
| 1 | MIANTYLLT | 0.050 | 182. |
| 2 | IANTYLLTS | 0.050 | 183. |
| 6 | YLLTSPLMN | 0.050 | 184. |
| 9 | TSPLMNPVI | 0.030 | 185. |
| 4 | NTYLLTSPL | 0.025 | 186. |
| 7 | LLTSPLMNP | 0.005 | 187. |
| 5 | TYLLTSPLM | 0.001 | 188. |
| 3 | ANTYLLTSP | 0.000 | 189. |

TABLE VI

V1-A1-10mers: 238P1B2

| Pos | 1234567890 | Score | SEQ ID |
|---|---|---|---|
| 10 | ATDLGLSIST | 6.250 | 190. |
| 150 | GVDLLLILLS | 2.500 | 191. |
| 65 | FVAVSNPLRY | 2.500 | 192. |
| 101 | MVALLIRLSY | 2.500 | 193. |
| 51 | VMESSVLLAM | 2.250 | 194. |
| 225 | ISPLMNPVIY | 1.500 | 195. |
| 184 | VSHIVAFAIY | 1.500 | 196. |
| 78 | LTDSRIAQIG | 1.250 | 197. |
| 98 | LTPMVALLIR | 1.250 | 198. |
| 131 | CTDTRTNSAV | 1.250 | 199. |
| 38 | ACLSHMFFIK | 1.000 | 200. |
| 228 | LMNPVIYSVK | 1.000 | 201. |
| 199 | SLSIVHRFGK | 1.000 | 202. |
| 53 | ESSVLLAMAF | 0.750 | 203. |
| 39 | CLSHMFFIKF | 0.500 | 204. |
| 55 | SVLLAMAFDR | 0.500 | 205. |
| 156 | ILLSYVLIIR | 0.500 | 206. |
| 20 | LVTMLSIFWF | 0.500 | 207. |
| 213 | YVHTMIANTY | 0.500 | 208. |
| 97 | MLTPMVALLI | 0.500 | 209. |
| 181 | STCVSHIVAF | 0.500 | 210. |
| 68 | VSNPLRYAMI | 0.300 | 211. |
| 168 | LSVASPEERK | 0.300 | 212. |
| 137 | NSAVGLTAMF | 0.300 | 213. |
| 18 | STLVTMLSIF | 0.250 | 214. |
| 172 | SPEERKETFS | 0.225 | 215. |
| 243 | RAVIKILHSK | 0.200 | 216. |
| 224 | LISPLMNPVI | 0.200 | 217. |
| 40 | LSHMFFIKFF | 0.150 | 218. |
| 171 | ASPEERKETF | 0.150 | 219. |
| 113 | SQVLHHSYCY | 0.150 | 220. |
| 185 | SHIVAFAIYY | 0.125 | 221. |
| 151 | VDLLLILLSY | 0.125 | 222. |
| 36 | FNACLSHMFF | 0.125 | 223. |
| 123 | HPDVMKLSCT | 0.125 | 224. |
| 147 | STVGVDLLLI | 0.125 | 225. |
| 170 | VASPEERKET | 0.100 | 226. |
| 56 | VLLAMAFDRF | 0.100 | 227. |
| 167 | VLSVASPEER | 0.100 | 228. |
| 23 | MLSIFWFNVR | 0.100 | 229. |
| 197 | LISLSIVHRF | 0.100 | 230. |
| 31 | VREISFNACL | 0.090 | 231. |
| 234 | YSVKTKQIRR | 0.075 | 232. |
| 8 | LSATDLGLSI | 0.075 | 233. |
| 180 | FSTCVSHIVA | 0.075 | 234. |
| 146 | FSTVGVDLLL | 0.075 | 235. |
| 17 | ISTLVTMLSI | 0.075 | 236. |
| 129 | LSCTDTRINS | 0.075 | 237. |
| 89 | ASVIRGLLML | 0.075 | 238. |
| 204 | HRFGKQAPAY | 0.050 | 239. |
| 94 | GLLMLTPMVA | 0.050 | 240. |
| 85 | QIGVASVIRG | 0.050 | 241. |
| 88 | VASVIRGLLM | 0.050 | 242. |
| 220 | NTYLLISPLM | 0.050 | 243. |
| 183 | CVSHIVAFAI | 0.050 | 244. |
| 190 | FAIYYIPLIS | 0.050 | 245. |
| 135 | RINSAVGLTA | 0.050 | 246. |
| 76 | MILTDSRIAQ | 0.050 | 247. |
| 37 | NACLSHMFFI | 0.050 | 248. |
| 215 | HTMIANTYLL | 0.050 | 249. |
| 217 | MIANTYLLIS | 0.050 | 250. |
| 155 | LILLSYVLII | 0.050 | 251. |
| 188 | VAFAIYYIPL | 0.050 | 252. |
| 49 | FTVMESSVLL | 0.050 | 253. |
| 148 | TVGVDLLLIL | 0.050 | 254. |
| 50 | TVMESSVLLA | 0.050 | 255. |
| 191 | AIYYIPLISL | 0.050 | 256. |
| 16 | SISTLVTMLS | 0.050 | 257. |
| 33 | EISFNACLSH | 0.050 | 258. |
| 19 | TLVTMLSIFW | 0.050 | 259. |
| 142 | LTAMFSTVGV | 0.050 | 260. |
| 120 | YCYHPDVMKL | 0.050 | 261. |
| 138 | SAVGLTAMFS | 0.050 | 262. |
| 139 | AVGLTAMFST | 0.050 | 263. |

TABLE VI-continued

V1-A1-10mers: 238P1B2

| Pos | 1234567890 | Score | SEQ ID |
|---|---|---|---|
| 230 | NPVIYSVKTK | 0.050 | 264. |
| 161 | VLIIRTVLSV | 0.050 | 265. |
| 58 | LAMAFDRFVA | 0.050 | 266. |
| 157 | LLSYVLIIRT | 0.050 | 267. |
| 176 | RKETFSTCVS | 0.045 | 268. |
| 84 | AQIGVASVIR | 0.030 | 269. |
| 108 | LSYCHSQVLH | 0.030 | 270. |
| 178 | ETFSTCVSHI | 0.025 | 271. |
| 6 | SMLSATDLGL | 0.025 | 272. |
| 111 | CHSQVLHHSY | 0.025 | 273. |
| 21 | VTMLSIFWFN | 0.025 | 274. |
| 27 | FWFNVREISF | 0.025 | 275. |
| 193 | YYIPLISLSI | 0.025 | 276. |
| 42 | HMFFIKFFTV | 0.025 | 277. |
| 216 | TMIANTYLLI | 0.025 | 278. |
| 22 | TMLSIFWFNV | 0.025 | 279. |
| 14 | GLSISTLVTM | 0.020 | 280. |
| 119 | SYCYHPDVMK | 0.020 | 281. |
| 103 | ALLIRLSYCH | 0.020 | 282. |
| 182 | TCVSHIVAFA | 0.020 | 283. |
| 60 | MAFDRFVAVS | 0.020 | 284. |
| 153 | LLLILLSYVL | 0.020 | 285. |
| 154 | LLILLSYVLI | 0.020 | 286. |
| 160 | YVLIIRTVLS | 0.020 | 287. |
| 82 | RIAQIGVASV | 0.020 | 288. |
| 67 | AVSNPLRYAM | 0.020 | 289. |

TABLE VI

V1B-A1-10mers: 238P1B2

| Pos | 1234567890 | Score | SEQ ID |
|---|---|---|---|
| 59 | LHEPMYYFLS | 2.250 | 290. |
| 23 | GLEAFHTWIS | 0.900 | 291. |
| 31 | ISIPFCFLSV | 0.750 | 292. |
| 56 | QPSLHEPMYY | 0.625 | 293. |
| 42 | ALLGNSLILF | 0.500 | 294. |
| 54 | ITQPSLHEPM | 0.250 | 295. |
| 18 | LTGVPGLEAF | 0.250 | 296. |
| 55 | TQPSLHEPMY | 0.150 | 297. |
| 2 | ITSTLQNITS | 0.125 | 298. |
| 7 | QNITSTSIIF | 0.125 | 299. |
| 28 | HTWISIPFCF | 0.125 | 300. |
| 9 | ITSTSIIFLL | 0.125 | 301. |
| 11 | STSIIFLLTG | 0.125 | 302. |
| 10 | TSTSIIFLLT | 0.075 | 303. |
| 19 | TGVPGLEAFH | 0.050 | 304. |
| 47 | SLILFATITQ | 0.050 | 305. |
| 37 | FLSVTALLGN | 0.050 | 306. |
| 20 | GVPGLEAFHT | 0.050 | 307. |
| 30 | WISIPFCFLS | 0.050 | 308. |
| 8 | NITSTSIIFL | 0.050 | 309. |
| 43 | LLGNSLILFA | 0.050 | 310. |
| 41 | TALLGNSLIL | 0.050 | 311. |
| 17 | LLTGVPGLEA | 0.050 | 312. |
| 57 | PSLHEPMYYF | 0.030 | 313. |
| 40 | VTALLGNSLI | 0.025 | 314. |
| 4 | STLQNITSTS | 0.025 | 315. |
| 26 | AFHTWISIPF | 0.025 | 316. |
| 58 | SLHEPMYYFL | 0.020 | 317. |
| 35 | FCFLSVTALL | 0.020 | 318. |
| 14 | IIFLLTGVPG | 0.020 | 319. |
| 46 | NSLILFATIT | 0.015 | 320. |
| 3 | TSTLQNITST | 0.015 | 321. |
| 38 | LSVTALLGNS | 0.015 | 322. |
| 12 | TSIIFLLTGV | 0.015 | 323. |
| 52 | ATITQPSLHE | 0.013 | 324. |
| 44 | LGNSLILFAT | 0.013 | 325. |
| 1 | FITSTLQNIT | 0.010 | 326. |
| 5 | TLQNITSTSI | 0.010 | 327. |
| 32 | SIPFCFLSVT | 0.010 | 328. |
| 39 | SVTALLGNSL | 0.010 | 329. |
| 49 | ILFATITQPS | 0.010 | 330. |
| 51 | FATITQPSLH | 0.010 | 331. |
| 45 | GNSLILFATI | 0.005 | 332. |

TABLE VI-continued

V1B-A1-10mers: 238P1B2

| Pos | 1234567890 | Score | SEQ ID |
|---|---|---|---|
| 33 | IPFCFLSVTA | 0.005 | 333. |
| 60 | HEPMYYFLSM | 0.003 | 334. |
| 24 | LEAFHTWISI | 0.003 | 335. |
| 36 | CFLSVTALLG | 0.003 | 336. |
| 21 | VPGLEAFHTW | 0.003 | 337. |
| 61 | EPMYYFLSML | 0.003 | 338. |
| 62 | PMYYFLSMLS | 0.003 | 339. |
| 6 | LQNITSTSII | 0.002 | 340. |
| 27 | FHTWISIPFC | 0.001 | 341. |
| 16 | FLLTGVPGLE | 0.001 | 342. |
| 13 | SIIFLLTGVP | 0.001 | 343. |
| 50 | LFATITQPSL | 0.001 | 344. |
| 25 | EAFHTWISIP | 0.001 | 345. |
| 48 | LILFATITQP | 0.001 | 346. |
| 15 | IFLLTGVPGL | 0.001 | 347. |
| 53 | TITQPSLHEP | 0.001 | 348. |
| 29 | TWISIPFCFL | 0.001 | 349. |
| 22 | PGLEAFHTWI | 0.000 | 350. |
| 34 | PFCFLSVTAL | 0.000 | 351. |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE VI-continued

V1B-A1-10mers: 238P1B2

| Pos | 1234567890 | Score | SEQ ID |
|---|---|---|---|
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE VI

V2-A1-10mers

| Pos | 1234567890 | Score | SEQ ID |
|---|---|---|---|
| 10 | TSPLMNPVIY | 1.500 | 352. |
| 9 | LTSPLMNPVI | 0.500 | 353. |
| 5 | NTYLLTSPLM | 0.050 | 354. |
| 2 | MIANTYLLTS | 0.050 | 355. |
| 1 | TMIANTYLLT | 0.025 | 356. |
| 8 | LLTSPLMNPV | 0.010 | 357. |
| 7 | YLLTSPLMNP | 0.005 | 358. |
| 6 | TYLLTSPLMN | 0.003 | 359. |
| 4 | ANTYLLTSPL | 0.003 | 360. |
| 3 | IANTYLLTSP | 0.001 | 361. |

TABLE VII

V1-A2-9mers: 238P1B2

| Pos | 123456789 | Score | SEQ ID |
|-----|-----------|-------|--------|
| 153 | LLLILLSYV | 5534.148 | 362. |
| 23 | MLSIFWFNV | 4430.156 | 363. |
| 94 | GLLMLTPMV | 257.342 | 364. |
| 103 | ALLIRLSYC | 232.527 | 365. |
| 96 | LMLTPMVAL | 223.203 | 366. |
| 228 | LMNPVIYSV | 196.407 | 367. |
| 141 | GLTAMFSTV | 132.149 | 368. |
| 97 | MLTPMVALL | 83.527 | 369. |
| 107 | RLSYCHSQV | 69.552 | 370. |
| 156 | ILLSYVLII | 61.882 | 371. |
| 60 | MAFDRFVAV | 47.333 | 372. |
| 224 | LISPLMNPV | 37.393 | 373. |
| 162 | LIIRTVLSV | 37.393 | 374. |
| 128 | KLSCTDTRI | 36.515 | 375. |
| 7 | MLSATDLGL | 36.316 | 376. |
| 50 | TVMESSVLL | 28.356 | 377. |
| 58 | LAMAFDRFV | 25.398 | 378. |
| 42 | HMFFIKFFT | 21.598 | 379. |
| 187 | IVAFAIYYI | 19.631 | 380. |
| 38 | ACLSHMFFI | 18.488 | 381. |
| 22 | TMLSIFWFN | 15.607 | 382. |
| 216 | TMIANTYLL | 15.428 | 383. |
| 154 | LLILLSYVL | 14.890 | 384. |
| 155 | LILLSYVLI | 13.535 | 385. |
| 160 | YVLIIRTVL | 13.044 | 386. |
| 95 | LLMLTPMVA | 12.812 | 387. |
| 59 | AMAFDRFVA | 8.532 | 388. |
| 75 | AMILTDSRI | 7.535 | 389. |
| 213 | YVHTMIANT | 6.899 | 390. |
| 16 | SISTLVTML | 6.756 | 391. |
| 194 | YIPLISLSI | 6.599 | 392. |
| 183 | CVSHIVAFA | 5.499 | 393. |
| 90 | SVIRGLLML | 4.299 | 394. |
| 140 | VGLTAMFST | 4.082 | 395. |
| 208 | KQAPAYVHT | 3.967 | 396. |
| 83 | IAQIGVASV | 3.777 | 397. |
| 12 | DLGLSISTL | 3.685 | 398. |
| 217 | MIANTYLLI | 3.658 | 399. |
| 143 | TAMFSTVGV | 3.574 | 400. |
| 43 | MFFIKFFTV | 3.348 | 401. |
| 14 | GLSISTLVT | 3.055 | 402. |
| 13 | LGLSISTLV | 2.856 | 403. |
| 202 | IVHRFGKQA | 2.808 | 404. |
| 113 | SQVLHHSYC | 2.770 | 405. |
| 195 | IPLISLSIV | 2.693 | 406. |
| 220 | NTYLLISPL | 2.184 | 407. |
| 148 | TVGVDLLLI | 2.100 | 408. |
| 150 | GVDLLLILL | 1.720 | 409. |
| 32 | REISFNACL | 1.578 | 410. |
| 190 | FAIYYIPLI | 1.533 | 411. |
| 222 | YLLISPLMN | 1.268 | 8912 |
| 18 | STLVTMLSI | 1.233 | 8913 |
| 67 | AVSNPLRYA | 1.100 | 412. |
| 115 | VLHHSYCYH | 1.045 | 413. |
| 149 | VGVDLLLIL | 0.917 | 414. |
| 51 | VMESSVLLA | 0.898 | 415. |
| 5 | LSMLSATDL | 0.877 | 416. |
| 87 | GVASVIRGL | 0.860 | 417. |
| 180 | FSTCVSHIV | 0.856 | 418. |
| 30 | NVREISFNA | 0.786 | 419. |
| 100 | PMVALLIRL | 0.781 | 420. |
| 146 | FSTVGVDLL | 0.723 | 421. |
| 184 | VSHIVAFAI | 0.671 | 422. |
| 158 | LSYVLIIRT | 0.609 | 423. |
| 9 | SATDLGLSI | 0.594 | 424. |
| 49 | FTVMESSVL | 0.560 | 425. |
| 56 | VLLAMAFDR | 0.544 | 426. |
| 21 | VTMLSIFWF | 0.478 | 427. |
| 84 | AQIGVASVI | 0.434 | 428. |
| 206 | FGKQAPAYV | 0.402 | 429. |
| 52 | MESSVLLAM | 0.378 | 430. |
| 76 | MILTDSRIA | 0.352 | 431. |
| 126 | VMKLSCTDT | 0.320 | 432. |
| 108 | LSYCHSQVL | 0.311 | 433. |

TABLE VII-continued

V1-A2-9mers: 238P1B2

| Pos | 123456789 | Score | SEQ ID |
|---|---|---|---|
| 135 | RINSAVGLT | 0.306 | 434. |
| 91 | VIRGLLMLT | 0.304 | 435. |
| 147 | STVGVDLLL | 0.297 | 436. |
| 93 | RGLLMLTPM | 0.276 | 437. |
| 240 | QIRRAVIKI | 0.251 | 438. |
| 98 | LTPMVALLI | 0.246 | 439. |
| 78 | LTDSRIAQI | 0.227 | 440. |
| 48 | FFTVMESSV | 0.222 | 441. |
| 70 | NPLRYAMIL | 0.212 | 442. |
| 215 | HTMIANTYL | 0.205 | 443. |
| 3 | YFLSMLSAT | 0.203 | 444. |
| 171 | ASPEERKET | 0.199 | 445. |
| 209 | QAPAYVHTM | 0.159 | 446. |
| 15 | LSISTLVTM | 0.127 | 447. |
| 104 | LLIRLSYCH | 0.127 | 448. |
| 161 | VLIIRTVLS | 0.127 | 449. |
| 57 | LLAMAFDRF | 0.118 | 450. |
| 77 | ILTDSRIAQ | 0.104 | 451. |
| 69 | SNPLRYAMI | 0.102 | 452. |
| 6 | SMLSATDLG | 0.098 | 453. |
| 132 | TDTRINSAV | 0.097 | 454. |
| 163 | IIRTVLSVA | 0.083 | 455. |
| 199 | SLSIVHRFG | 0.082 | 456. |
| 227 | PLMNPVIYS | 0.077 | 457. |
| 137 | NSAVGLTAM | 0.075 | 458. |
| 19 | TLVTMLSIF | 0.070 | 459. |

TABLE VII

V1B-A2-9mers: 238P1B2

| Pos | 123456789 | Score | SEQ ID |
|---|---|---|---|
| 16 | FLLTGVPGL | 836.253 | 460. |
| 30 | WISIPFCFL | 141.197 | 461. |
| 42 | ALLGNSLIL | 32.407 | 462. |
| 13 | SIIFLLTGV | 21.996 | 463. |
| 32 | SIPFCFLSV | 18.170 | 464. |
| 1 | FITSTLQNI | 15.177 | 465. |

TABLE VII-continued

V1B-A2-9mers: 238P1B2

| Pos | 123456789 | Score | SEQ ID |
|---|---|---|---|
| 23 | GLEAFHTWI | 13.955 | 466. |
| 47 | SLILFATIT | 11.610 | 467. |
| 62 | PMYYFLSML | 9.493 | 468. |
| 9 | ITSTSIIFL | 6.381 | 469. |
| 35 | FCFLSVTAL | 5.459 | 470. |
| 58 | SLHEPMYYF | 3.865 | 471. |
| 10 | TSTSIIFLL | 1.860 | 472. |
| 6 | LQNITSTSI | 1.798 | 473. |
| 51 | FATITQPSL | 1.365 | 474. |
| 33 | IPFCFLSVT | 1.096 | 475. |
| 4 | STLQNITST | 0.881 | 476. |
| 44 | LGNSLILFA | 0.697 | 477. |
| 45 | GNSLILFAT | 0.649 | 478. |
| 41 | TALLGNSLI | 0.536 | 479. |
| 40 | VTALLGNSL | 0.504 | 480. |
| 21 | VPGLEAFHT | 0.480 | 481. |
| 46 | NSLILFATI | 0.479 | 482. |
| 37 | FLSVTALLG | 0.343 | 483. |
| 43 | LLGNSLILF | 0.291 | 484. |
| 55 | TQPSLHEPM | 0.247 | 485. |
| 28 | HTWISIPFC | 0.246 | 486. |
| 49 | TLFATITQP | 0.216 | 487. |
| 11 | STSIIFLLT | 0.197 | 488. |
| 18 | LTGVPGLEA | 0.117 | 489. |
| 5 | TLQNITSTS | 0.075 | 490. |
| 2 | ITSTLQNIT | 0.072 | 491. |
| 25 | EAFHTWISI | 0.068 | 492. |
| 36 | CFLSVTALL | 0.055 | 493. |
| 20 | GVPGLEAFH | 0.036 | 494. |
| 7 | QNITSTSII | 0.028 | 495. |
| 31 | ISIPFCFLS | 0.018 | 496. |
| 61 | EPMYYFLSM | 0.017 | 497. |
| 59 | LHEPMYYFL | 0.013 | 498. |
| 48 | LILFATITQ | 0.013 | 499. |
| 24 | LEAFHTWIS | 0.008 | 500. |
| 12 | TSIIFLLTG | 0.004 | 501. |
| 8 | NITSTSIIF | 0.004 | 502. |

TABLE VII-continued

V1B-A2-9mers: 238P1B2

| Pos | 123456789 | Score | SEQ ID |
|---|---|---|---|
| 17 | LLTGVPGLE | 0.003 | 503. |
| 53 | TITQPSLHE | 0.002 | 504. |
| 39 | SVTALLGNS | 0.002 | 505. |
| 38 | LSVTALLGN | 0.002 | 506. |
| 52 | ATITQPSLH | 0.001 | 507. |
| 54 | ITQPSLHEP | 0.001 | 508. |
| 14 | IIFLLTGVP | 0.001 | 509. |
| 19 | TGVPGLEAF | 0.001 | 510. |
| 3 | TSTLQNITS | 0.000 | 511. |
| 56 | QPSLHEPMY | 0.000 | 512. |
| 60 | HEPMYYFLS | 0.000 | 513. |
| 15 | IFLLTGVPG | 0.000 | 514. |
| 22 | PGLEAFHTW | 0.000 | 515. |
| 27 | FHTWISIPF | 0.000 | 516. |
| 57 | PSLHEPMYY | 0.000 | 517. |
| 50 | LFATITQPS | 0.000 | 518. |
| 34 | PFCFLSVTA | 0.000 | 519. |
| 29 | TWISIPFCF | 0.000 | 520. |
| 26 | AFHTWISIP | 0.000 | 521. |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE VII-continued

V1B-A2-9mers: 238P1B2

| Pos | 123456789 | Score | SEQ ID |
|---|---|---|---|
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE VII

V2-A2-9mers: 238P1B2

| Pos | 123456789 | Score | SEQ ID |
|---|---|---|---|
| 8 | LTSPLMNPV | 3.777 | 522. |
| 1 | MIANTYLLT | 2.613 | 523. |
| 6 | YLLTSPLMN | 1.268 | 524. |
| 4 | NTYLLTSPL | 0.949 | 525. |
| 7 | LLTSPLMNP | 0.058 | 526. |
| 9 | TSPLMNPVI | 0.028 | 527. |
| 2 | IANTYLLTS | 0.004 | 528. |
| 5 | TYLLTSPLM | 0.003 | 529. |
| 3 | ANTYLLTSP | 0.000 | 530. |

TABLE VIII

V1-A2-10mers: 238P1B2

| Pos | 1234567890 | Score | SEQ ID |
|---|---|---|---|
| 22 | TMLSIFWFNV | 6963.743 | 531. |
| 57 | LLAMAFDRFV | 494.237 | 532. |
| 95 | LLMLTPMVAL | 309.050 | 533. |
| 223 | LLISPLMNPV | 271.948 | 534. |
| 161 | VLIIRTVLSV | 271.948 | 535. |
| 152 | DLLLILLSYV | 244.154 | 536. |
| 96 | LMLTPMVALL | 223.203 | 537. |
| 77 | ILTDSRIAQI | 167.248 | 538. |
| 4 | FLSMLSATDL | 98.267 | 539. |
| 59 | AMAFDRFVAV | 95.441 | 540. |
| 42 | HMFFIKFFTV | 69.637 | 541. |
| 144 | AMFSTVGVDL | 57.085 | 542. |
| 6 | SMLSATDLGL | 57.085 | 543. |
| 153 | LLLILLSYVL | 55.091 | 544. |
| 194 | YIPLISLSIV | 41.484 | 545. |
| 157 | LLSYVLIIRT | 29.137 | 546. |
| 154 | LLILLSYVLI | 26.604 | 547. |
| 82 | RIAQIGVASV | 21.996 | 548. |
| 191 | AIYYIPLISL | 21.619 | 549. |
| 97 | MLTPMVALLI | 17.736 | 550. |
| 50 | TVMESSVLLA | 15.167 | 551. |
| 227 | PLMNPVIYSV | 13.022 | 552. |
| 14 | GLSISTLVTM | 11.426 | 553. |
| 216 | TMIANTYLLI | 11.302 | 554. |
| 37 | NACLSHMFFI | 10.631 | 555. |
| 107 | RLSYCHSQVL | 8.759 | 556. |
| 139 | AVGLTAMFST | 8.698 | 557. |
| 239 | KQIRRAVIKI | 8.515 | 558. |
| 155 | LILLSYVLII | 8.509 | 559. |
| 232 | VIYSVKTKQI | 7.804 | 560. |
| 94 | GLLMLTPMVA | 7.536 | 561. |
| 102 | VALLIRLSYC | 5.490 | 562. |
| 140 | VGLTAMFSTV | 5.426 | 563. |
| 183 | CVSHIVAFAI | 5.295 | 564. |
| 12 | DLGLSISTLV | 5.216 | 565. |
| 120 | YCYHPDVMKL | 4.721 | 566. |
| 208 | KQAPAYVHTM | 4.055 | 567. |
| 188 | VAFAIYYIPL | 2.799 | 568. |
| 201 | SIVHRFGKQA | 2.596 | 569. |
| 74 | YAMILTDSRI | 2.466 | 570. |
| 25 | SIFWFNVREI | 2.442 | 571. |
| 149 | VGVDLLLILL | 2.236 | 572. |
| 148 | TVGVDLLLIL | 1.763 | 573. |
| 93 | RGLLMLTPMV | 1.680 | 574. |
| 142 | LTAMFSTVGV | 1.642 | 575. |
| 90 | SVIRGLLMLT | 1.500 | 576. |
| 49 | ETVMESSVLL | 1.365 | 577. |
| 99 | TPMVALLIRL | 1.187 | 578. |
| 158 | LSYVLIIRTV | 1.136 | 579. |
| 162 | LIIRTVLSVA | 1.095 | 580. |
| 58 | LAMAFDRFVA | 1.032 | 581. |
| 224 | LISPLMNPVI | 1.000 | 582. |
| 51 | VMESSVLLAM | 0.898 | 583. |
| 29 | FNVREISFNA | 0.865 | 584. |
| 20 | LVTMLSIFWF | 0.813 | 585. |
| 135 | RINSAVGLTA | 0.683 | 586. |
| 146 | FSTVGVDLLL | 0.641 | 587. |
| 47 | KFFTVMESSV | 0.625 | 588. |
| 186 | HIVAFAIYYI | 0.617 | 589. |
| 41 | SHMFFIKFFT | 0.611 | 590. |
| 222 | YLLISPLMNP | 0.583 | 591. |
| 15 | LSISTLVTML | 0.545 | 592. |
| 39 | CLSHMFFIKF | 0.538 | 593. |
| 21 | VTMLSIFWFN | 0.510 | 594. |
| 34 | ISFNACLSHM | 0.469 | 595. |
| 56 | VLLAMAFDRF | 0.436 | 596. |
| 67 | AVSNPLRYAM | 0.435 | 597. |
| 70 | NPLRYAMILT | 0.414 | 598. |
| 182 | TCVSHIVAFA | 0.410 | 599. |
| 19 | TLVTMLSIFW | 0.410 | 600. |
| 131 | CTDTRINSAV | 0.386 | 601. |
| 52 | MESSVLLAMA | 0.378 | 602. |
| 147 | STVGVDLLLI | 0.333 | 603. |
| 219 | ANTYLLISPL | 0.321 | 604. |

TABLE VIII-continued

V1-A2-10mers: 238P1B2

| Pos | 1234567890 | Score | SEQ ID |
|---|---|---|---|
| 89 | ASVIRGLLML | 0.321 | 605. |
| 130 | SCTDTRINSA | 0.306 | 606. |
| 66 | VAVSNPLRYA | 0.297 | 607. |
| 75 | AMILTDSRIA | 0.294 | 608. |
| 103 | ALLIRLSYCH | 0.276 | 609. |
| 17 | ISTLVTMLSI | 0.266 | 610. |
| 205 | RFGKQAPAYV | 0.266 | 611. |
| 30 | NVREISFNAC | 0.257 | 612. |
| 11 | TDLGLSISTL | 0.252 | 613. |
| 87 | GVASVIRGLL | 0.243 | 614. |
| 220 | NTYLLISPLM | 0.221 | 615. |
| 240 | QIRRAVIKIL | 0.211 | 616. |
| 114 | QVLHHSYCYH | 0.199 | 617. |
| 104 | LLIRLSYCHS | 0.190 | 618. |
| 125 | DVMKLSCTDT | 0.181 | 619. |
| 170 | VASPEERKET | 0.176 | 620. |
| 68 | VSNPLRYAMI | 0.174 | 621. |
| 209 | QAPAYVHTMI | 0.145 | 622. |
| 214 | VHTMIANTYL | 0.139 | 623. |
| 136 | INSAVGLTAM | 0.127 | 624. |
| 13 | LGLSISTLVT | 0.125 | 625. |
| 88 | VASVIRGLLM | 0.117 | 626. |
| 141 | GLTAMFSTVG | 0.116 | 627. |
| 8 | LSATDLGLSI | 0.116 | 628. |
| 160 | YVLIIRTVLS | 0.111 | 629. |
| 86 | IGVASVIRGL | 0.109 | 630. |

TABLE VIII

V1B-A2-10mers: 238P1B2

| Pos | 1234567890 | Score | SEQ ID |
|---|---|---|---|
| 58 | SLHEPMYYFL | 722.583 | 631. |
| 43 | LLGNSLILFA | 106.837 | 632. |
| 8 | NITSTSIIFL | 37.157 | 633. |
| 5 | TLQNITSTSI | 10.433 | 634. |
| 17 | LLTGVPGLEA | 8.446 | 635. |
| 9 | ITSTSIIFLL | 6.729 | 636. |

TABLE VIII-continued

V1B-A2-10mers: 238P1B2

| Pos | 1234567890 | Score | SEQ ID |
|---|---|---|---|
| 20 | GVPGLEAFHT | 3.782 | 637. |
| 32 | SIPFCFLSVT | 3.672 | 638. |
| 35 | FCELSVTALL | 2.373 | 639. |
| 1 | FITSTLQNIT | 1.932 | 640. |
| 39 | SVTALLGNSL | 1.869 | 641. |
| 31 | ISIPFCFLSV | 1.466 | 642. |
| 44 | LGNSLILFAT | 1.103 | 643. |
| 12 | TSIIFLLTGV | 1.044 | 644. |
| 30 | WISIPFCFLS | 1.039 | 645. |
| 37 | FLSVTALLGN | 0.788 | 646. |
| 6 | LQNITSTSII | 0.737 | 647. |
| 42 | ALLGNSLILF | 0.634 | 648. |
| 24 | LEAFHTWISI | 0.586 | 649. |
| 22 | PGLEAFHTWI | 0.475 | 650. |
| 49 | ILFATITQPS | 0.469 | 651. |
| 41 | TALLGNSLIL | 0.450 | 652. |
| 61 | EPMYYFLSML | 0.338 | 653. |
| 46 | NSLILFATIT | 0.280 | 654. |
| 40 | VTALLGNSLI | 0.246 | 655. |
| 15 | IFLLTGVPGL | 0.215 | 656. |
| 33 | IPFCFLSVTA | 0.204 | 657. |
| 27 | FHTWISIPFC | 0.201 | 658. |
| 45 | GNSLILFATI | 0.129 | 659. |
| 3 | TSTLQNITST | 0.112 | 660. |
| 10 | TSTSIIFLLT | 0.092 | 661. |
| 14 | IIFLLTGVPG | 0.064 | 662. |
| 54 | ITQPSLHEPM | 0.057 | 663. |
| 16 | FLLTGVPGLE | 0.033 | 664. |
| 29 | TWISIPFCFL | 0.031 | 665. |
| 48 | LILFATITQP | 0.030 | 666. |
| 50 | LFATITQPSL | 0.025 | 667. |
| 47 | SLILFATITQ | 0.015 | 668. |
| 23 | GLEAFHTWIS | 0.015 | 669. |
| 11 | STSIIFLLTG | 0.009 | 670. |
| 55 | TQPSLHEPMY | 0.008 | 671. |
| 60 | HEPMYYFLSM | 0.006 | 672. |
| 51 | FATITQPSLH | 0.005 | 673. |

TABLE VIII-continued

V1B-A2-10mers: 238P1B2

| Pos | 1234567890 | Score | SEQ ID |
|---|---|---|---|
| 53 | TITQPSLHEP | 0.005 | 674. |
| 4 | STLQNITSTS | 0.004 | 675. |
| 62 | PMYYFLSMLS | 0.004 | 676. |
| 19 | TGVPGLEAFH | 0.003 | 677. |
| 56 | QPSLHEPMYY | 0.003 | 678. |
| 18 | LTGVPGLEAF | 0.002 | 679. |
| 2 | ITSTLQNITS | 0.002 | 680. |
| 28 | HTWISIPFCF | 0.002 | 681. |
| 21 | VPGLEAFHTW | 0.002 | 682. |
| 34 | PFCFLSVTAL | 0.001 | 683. |
| 57 | PSLHEPMYYF | 0.001 | 684. |
| 38 | LSVTALLGNS | 0.000 | 685. |
| 52 | ATITQPSLHE | 0.000 | 686. |
| 7 | QNITSTSIIF | 0.000 | 687. |
| 36 | CFLSVTALLG | 0.000 | 688. |
| 13 | SIIFLLTGVP | 0.000 | 689. |
| 25 | EAFHTWISIP | 0.000 | 690. |
| 26 | AFHTWISIPF | 0.000 | 691. |
| 59 | LHEPMYYFLS | 0.000 | 692. |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE VIII-continued

V1B-A2-10mers: 238P1B2

| Pos | 1234567890 | Score | SEQ ID |
|---|---|---|---|
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE VIII

V2-A2-10mers

| Pos | 1234567890 | Score | SEQ ID |
|---|---|---|---|
| 8 | LLTSPLMNPV | 271.948 | 693. |
| 1 | TMIANTYLLT | 8.073 | 694. |
| 7 | YLLTSPLMNP | 0.583 | 695. |
| 5 | NTYLLTSPLM | 0.221 | 696. |
| 4 | ANTYLLTSPL | 0.139 | 697. |
| 9 | LTSPLMNPVI | 0.101 | 698. |
| 2 | MIANTYLLTS | 0.040 | 699. |
| 3 | IANTYLLTSP | 0.001 | 700. |
| 10 | TSPLMNPVIY | 0.000 | 701. |
| 6 | TYLLTSPLMN | 0.000 | 702. |

TABLE IX

V1-A3-9-mers: 238P1B2

| Pos | 123456789 | Score | SEQ ID |
|---|---|---|---|
| 39 | CLSHMFFIK | 180.000 | 703. |
| 157 | LLSYVLIIR | 18.000 | 704. |
| 56 | VLLANAFDR | 18.000 | 705. |
| 156 | ILLSYVLII | 16.200 | 706. |
| 152 | DLLLILLSY | 8.100 | 707. |
| 244 | AVIKILHSK | 6.750 | 708. |
| 57 | LLAMAFDRF | 6.000 | 709. |
| 19 | TLVTMLSIF | 4.500 | 710. |
| 186 | HIVAFAIYY | 3.600 | 711. |
| 169 | SVASPEERK | 3.000 | 712. |
| 216 | TMIANTYLL | 2.700 | 713. |
| 97 | MLTPMVALL | 2.700 | 714. |
| 239 | KQIRRAVIK | 2.700 | 715. |
| 154 | LLILLSYVL | 2.700 | 716. |
| 42 | HMFFIKFFT | 2.250 | 717. |
| 228 | LMNPVIYSV | 2.025 | 718. |
| 96 | LMLTPMVAL | 2.025 | 719. |
| 141 | GLTAMFSTV | 1.800 | 720. |
| 23 | MLSIFWFNV | 1.800 | 721. |
| 128 | KLSCTDTRI | 1.800 | 722. |
| 114 | QVLHHSYCY | 1.800 | 723. |
| 120 | YCYHPDVMK | 1.500 | 724. |
| 51 | VMESSVLLA | 1.200 | 725. |
| 7 | MLSATDLGL | 1.200 | 726. |
| 104 | LLIRLSYCH | 0.900 | 727. |
| 94 | GLLMLTPMV | 0.900 | 728. |
| 75 | AMTLTDSRI | 0.900 | 729. |
| 235 | SVKTKQIRR | 0.800 | 730. |
| 21 | VTMLSIFWF | 0.675 | 731. |
| 95 | LLMLTPMVA | 0.600 | 732. |
| 197 | LISLSIVHR | 0.600 | 733. |
| 59 | AMAFDRFVA | 0.600 | 734. |
| 14 | GLSISTLVT | 0.600 | 735. |
| 150 | GVDLLLILL | 0.540 | 736. |
| 103 | ALLIRLSYC | 0.450 | 737. |
| 153 | LLLILLSYV | 0.450 | 738. |
| 200 | LSIVHRFGK | 0.450 | 739. |
| 231 | PVIYSVKTK | 0.450 | 740. |
| 22 | TMLSIFWFN | 0.405 | 741. |
| 85 | QIGVASVIR | 0.400 | 742. |
| 65 | FVAVSNPLR | 0.400 | 743. |
| 240 | QIRRAVIKI | 0.360 | 744. |
| 12 | DLGLSISTL | 0.270 | 745. |
| 100 | PMVALLIRL | 0.270 | 746. |
| 24 | LSIFWFNVR | 0.270 | 747. |
| 90 | SVIRGLLML | 0.270 | 748. |
| 187 | IVAFAIYYI | 0.270 | 749. |
| 220 | NTYLLISPL | 0.225 | 750. |
| 147 | STVGVDLLL | 0.203 | 751. |
| 107 | RLSYCHSQV | 0.200 | 752. |
| 115 | VLHHSYCYH | 0.200 | 753. |
| 194 | YIPLISLSI | 0.180 | 754. |
| 16 | SISTLVTML | 0.180 | 755. |
| 148 | TVGVDLLLI | 0.180 | 756. |
| 162 | LIIRTVLSV | 0.180 | 757. |
| 40 | LSHMFFIKF | 0.180 | 758. |
| 99 | TPMVALLIR | 0.180 | 759. |
| 102 | VALLIRLSY | 0.180 | 760. |
| 50 | TVMESSVLL | 0.135 | 761. |
| 30 | NVREISFNA | 0.135 | 762. |
| 160 | YVLIIRTVL | 0.135 | 763. |
| 223 | LLISPLMNP | 0.135 | 764. |
| 18 | STLVTMLSI | 0.135 | 765. |
| 66 | VAVSNPLRY | 0.120 | 766. |
| 217 | MIANTYLLI | 0.120 | 767. |
| 126 | VMKLSCTDT | 0.100 | 768. |
| 183 | CVSHIVAFA | 0.090 | 769. |
| 98 | LTPMVALLI | 0.090 | 770. |
| 144 | AMFSTVGVD | 0.090 | 771. |
| 155 | LILLSYVLI | 0.090 | 772. |
| 198 | ISLSIVHRF | 0.068 | 773. |
| 84 | AQIGVASVI | 0.061 | 774. |
| 229 | MNPVIYSVK | 0.060 | 775. |
| 191 | AIYYIPLIS | 0.060 | 776. |

TABLE IX-continued

V1-A3-9-mers: 238P1B2

| Pos | 123456789 | Score | SEQ ID |
|---|---|---|---|
| 196 | PLISLSIVH | 0.060 | 777. |
| 161 | VLIIRTVLS | 0.060 | 778. |
| 74 | YAMILTDSR | 0.060 | 779. |
| 222 | YLLISPLMN | 0.060 | 780. |
| 226 | SPLMNPVIY | 0.060 | 781. |
| 227 | PLMNPVIYS | 0.054 | 782. |
| 70 | NPLRYAMIL | 0.054 | 783. |
| 163 | IIRTVLSVA | 0.045 | 784. |
| 49 | FTVMESSVL | 0.045 | 785. |
| 215 | HTMIANTYL | 0.045 | 786. |
| 182 | TCVSHIVAF | 0.045 | 787. |
| 91 | VIRGLLMLT | 0.045 | 788. |
| 138 | SAVGLTAMF | 0.045 | 789. |
| 78 | LTDSRIAQI | 0.045 | 790. |
| 224 | LISPLMNPV | 0.045 | 791. |
| 87 | GVASVIRGL | 0.041 | 792. |
| 190 | FAIYYIPLI | 0.041 | 793. |
| 38 | ACLSHMFFI | 0.041 | 794. |
| 37 | NACLSHMFF | 0.040 | 795. |
| 20 | LVTMLSIFW | 0.040 | 796. |
| 77 | ILTDSRIAQ | 0.040 | 797. |
| 234 | YSVKTKQIR | 0.030 | 798. |
| 25 | SIFWFNVRE | 0.030 | 799. |
| 6 | SMLSATDLG | 0.030 | 800. |
| 202 | IVHRFGKQA | 0.030 | 801. |
| 168 | LSVASPEER | 0.030 | 802. |

TABLE IX

V1B-A3-9mers: 238P1B2

| SEQ ID | Pos | 123456789 | Score |
|---|---|---|---|
| 803 | 58 | SLHEPMYYF | 20.250 |
| 804 | 43 | LLGNSLILF | 6.000 |
| 805 | 23 | GLEAFHTWI | 5.400 |
| 806 | 42 | ALLGNSLIL | 2.700 |
| 807 | 16 | FLLTGVPGL | 2.700 |
| 808 | 62 | PMYYFLSML | 1.350 |
| 809 | 47 | SLILFATIT | 0.450 |
| 810 | 8 | NITSTSIIF | 0.400 |
| 811 | 30 | WISIPFCFL | 0.270 |
| 812 | 49 | ILFATITQP | 0.150 |
| 813 | 32 | SIPFCFLSV | 0.120 |
| 814 | 9 | ITSTSIIFL | 0.090 |
| 815 | 20 | GVPGLEAFH | 0.090 |
| 816 | 1 | FITSTLQNI | 0.090 |
| 817 | 35 | FCFLSVTAL | 0.090 |
| 818 | 28 | HTWISIPFC | 0.075 |
| 819 | 5 | TLQNITSTS | 0.060 |
| 820 | 11 | STSIIFLLT | 0.045 |
| 821 | 13 | SIIFLLTGV | 0.045 |
| 822 | 37 | FLSVTALLG | 0.040 |
| 823 | 56 | QPSLHEPMY | 0.040 |
| 824 | 18 | LTGVPGLEA | 0.030 |
| 825 | 40 | VTALLGNSL | 0.030 |
| 826 | 33 | IPFCFLSVT | 0.022 |
| 827 | 10 | TSTSIIFLL | 0.020 |
| 828 | 6 | LQNITSTSI | 0.018 |
| 829 | 25 | EAFHTWISI | 0.018 |
| 830 | 61 | EPMYYFLSM | 0.016 |
| 831 | 52 | ATITQPSLH | 0.015 |
| 832 | 29 | TWISIPFCF | 0.013 |
| 833 | 17 | LLTGVPGLE | 0.013 |
| 834 | 46 | NSLILFATI | 0.013 |
| 835 | 4 | STLQNITST | 0.011 |
| 836 | 41 | TALLGNSLI | 0.009 |
| 837 | 19 | TGVPGLEAF | 0.007 |
| 838 | 27 | FHTWISIPF | 0.006 |
| 839 | 57 | PSLHEPMYY | 0.006 |
| 840 | 51 | FATITQPSL | 0.006 |
| 841 | 53 | TITQPSLHE | 0.006 |
| 842 | 48 | LILFATITQ | 0.006 |
| 843 | 55 | TQPSLHEPM | 0.006 |
| 844 | 2 | ITSTLQNIT | 0.005 |
| 845 | 45 | GNSLILFAT | 0.004 |

TABLE IX-continued

V1B-A3-9mers: 238P1B2

| SEQ ID | Pos | 123456789 | Score |
|---|---|---|---|
| 846 | 31 | ISIPFCFLS | 0.004 |
| 847 | 21 | VPGLEAFHT | 0.003 |
| 848 | 14 | IIFLLTGVP | 0.003 |
| 849 | 59 | LHEPMYYFL | 0.003 |
| 850 | 54 | ITQPSLHEP | 0.002 |
| 851 | 7 | QNITSTSII | 0.002 |
| 852 | 39 | SVTALLGNS | 0.002 |
| 853. | 36 | CFLSVTALL | 0.001 |
| 854. | 12 | TSIIFLLTG | 0.001 |
| 855. | 60 | HEPMYYFLS | 0.001 |
| 856. | 44 | LGNSLILFA | 0.001 |
| 857. | 38 | LSVTALLGN | 0.000 |
| 858. | 3 | TSTLQNITS | 0.000 |
| 859. | 24 | LEAFHTWIS | 0.000 |
| 860. | 22 | PGLEAFHTW | 0.000 |
| 861. | 26 | AFHTWISIP | 0.000 |
| 862. | 50 | LFATITQPS | 0.000 |
| 863. | 15 | IFLLTGVPG | 0.000 |
| 864. | 34 | PFCFLSVTA | 0.000 |

TABLE IX

V2-A3-9mers-238P1B2

| Pos | 123456789 | Score | SEQ ID |
|---|---|---|---|
| 4 | NTYLLTSPL | 0.150 | 865 |
| 7 | LLTSPLMNP | 0.090 | 866 |
| 6 | YLLTSPLMN | 0.060 | 867 |
| 8 | LTSPLMNPV | 0.022 | 868 |
| 1 | MIANTYLLT | 0.020 | 869 |
| 2 | IANTYLLTS | 0.004 | 870 |
| 9 | TSPLMNPVI | 0.003 | 871 |
| 5 | TYLLTSPLM | 0.000 | 872 |
| 3 | ANTYLLTSP | 0.000 | 873 |

TABLE X

V1-A3-10-mers: 238P1B2

| Pos | 1234567890 | Score | SEQ ID |
|---|---|---|---|
| 199 | SLSIVHRFGK | 60.000 | 874 |
| 228 | LMNPVIYSVK | 45.000 | 875 |
| 39 | CLSHMFFIKF | 36.000 | 876 |
| 23 | MLSIFWFNVR | 36.000 | 877 |
| 156 | ILLSYVLIIR | 27.000 | 878 |
| 42 | HMFFIKFFTV | 9.000 | 879 |
| 56 | VLLAMAFDRF | 9.000 | 880 |
| 144 | AMFSTVGVDL | 4.500 | 881 |
| 167 | VLSVASPEER | 4.000 | 882 |
| 126 | VMKLSCTDTR | 4.000 | 883 |
| 153 | LLLILLSYVL | 2.700 | 884 |
| 38 | ACLSHMFFIK | 2.700 | 885 |
| 22 | TMLSIFWFNV | 2.700 | 886 |
| 96 | LMLTPMVALL | 2.700 | 887 |
| 97 | MLTPMVALLI | 2.700 | 888 |
| 95 | LLMLTPMVAL | 2.025 | 889 |
| 6 | SMLSATDLGL | 1.800 | 890 |
| 94 | GLLMLTPMVA | 1.800 | 891 |
| 161 | VLIIRTVLSV | 1.800 | 892 |
| 216 | TMIANTYLLI | 1.800 | 893 |
| 55 | SVLLAMAFDR | 1.800 | 894 |
| 155 | LILLSYVLII | 1.620 | 895 |
| 191 | AIYYIPLISL | 1.350 | 896 |
| 101 | MVALLIRLSY | 1.200 | 897 |
| 14 | GLSISTLVTM | 0.900 | 898 |
| 51 | VMESSVLLAM | 0.900 | 899 |
| 197 | LISLSIVHRF | 0.900 | 900 |
| 196 | PLISLSIVHR | 0.900 | 901 |
| 20 | LVTMLSIFWF | 0.900 | 902 |
| 103 | ALLIRLSYCH | 0.900 | 903 |
| 77 | ILTDSRIAQI | 0.900 | 904 |
| 154 | LLILLSYVLI | 0.900 | 905 |
| 65 | FVAVSNPLRY | 0.800 | 906 |
| 243 | RAVIKILHSK | 0.675 | 907 |
| 98 | LTPMVALLIR | 0.600 | 908 |
| 4 | FLSMLSATDL | 0.600 | 909 |
| 107 | RLSYCHSQVL | 0.600 | 910 |
| 213 | YVHTMIANTY | 0.600 | 911 |
| 19 | TLVTMLSIFW | 0.600 | 912 |
| 59 | AMAFDRFVAV | 0.600 | 913 |
| 113 | SQVLHHSYCY | 0.540 | 914 |
| 239 | KQIRRAVIKI | 0.486 | 915 |
| 223 | LLISPLMNPV | 0.450 | 916 |
| 230 | NPVIYSVKTK | 0.450 | 917 |
| 186 | HIVAFAIYYI | 0.405 | 918 |
| 157 | LLSYVLIIRT | 0.300 | 919 |
| 84 | AQIGVASVIR | 0.270 | 920 |
| 50 | TVMESSVLLA | 0.270 | 921 |
| 183 | CVSHIVAFAI | 0.270 | 922 |
| 208 | KQAPAYVHTM | 0.243 | 923 |
| 18 | STLVTMLSIF | 0.225 | 924 |
| 168 | LSVASPEERK | 0.225 | 925 |
| 147 | STVGVDLLLI | 0.203 | 926 |
| 227 | PLMNPVIYSV | 0.203 | 927 |
| 148 | TVGVDLLLIL | 0.180 | 928 |
| 120 | YCYHPDVMKL | 0.180 | 929 |
| 115 | VLHHSYCYHP | 0.180 | 930 |
| 188 | VAFAIYYIPL | 0.180 | 931 |
| 141 | GLTAMESTVG | 0.180 | 932 |
| 181 | STCVSHIVAF | 0.150 | 933 |
| 232 | VIYSVKTKQI | 0.150 | 934 |
| 215 | HTMIANTYLL | 0.135 | 935 |
| 152 | DLLLILLSYV | 0.135 | 936 |
| 222 | YLLISPLMNP | 0.135 | 937 |
| 178 | ETFSTCVSHI | 0.135 | 938 |
| 30 | NVREISFNAC | 0.090 | 939 |
| 12 | DLGLSISTLV | 0.090 | 940 |
| 224 | LISPLMNPVI | 0.090 | 941 |
| 237 | KTKQIRRAVI | 0.090 | 942 |
| 25 | SIFWFNVREI | 0.090 | 943 |
| 87 | GVASVIRGLL | 0.081 | 944 |
| 220 | NTYLLISPLM | 0.075 | 945 |
| 240 | QIRRAVIKIL | 0.068 | 946 |
| 162 | LIIRTVLSVA | 0.068 | 947 |

TABLE X-continued

V1-A3-10-mers: 238P1B2

| Pos | 1234567890 | Score | SEQ ID |
|---|---|---|---|
| 135 | RINSAVGLTA | 0.060 | 948 |
| 67 | AVSNPLRYAM | 0.060 | 949 |
| 104 | LLIRLSYCHS | 0.060 | 950 |
| 57 | LLAMAFDRFV | 0.060 | 951 |
| 234 | YSVKTKQIRR | 0.060 | 952 |
| 184 | VSHIVAFAIY | 0.060 | 953 |
| 82 | RIAQIGVASV | 0.060 | 954 |
| 201 | SIVHREGKQA | 0.045 | 955 |
| 139 | AVGLTAMFST | 0.045 | 956 |
| 90 | SVIRGLLMLT | 0.045 | 957 |
| 49 | FTVMESSVLL | 0.045 | 958 |
| 185 | SHIVAFAIYY | 0.036 | 959 |
| 217 | MIANTYLLIS | 0.036 | 960 |
| 150 | GVDLLLILLS | 0.036 | 961 |
| 119 | SYCYHPDVMK | 0.030 | 962 |
| 194 | YIPLISLSIV | 0.030 | 963 |
| 114 | QVLHHSYCYH | 0.030 | 964 |
| 75 | AMILTDSRIA | 0.030 | 965 |
| 204 | HRFGKQAPAY | 0.030 | 966 |
| 37 | NACLSHMFFI | 0.027 | 967 |
| 99 | TPMVALLIRL | 0.027 | 968 |
| 151 | VDLLLILLSY | 0.027 | 969 |
| 45 | FIKFFTVMES | 0.024 | 970 |
| 40 | LSHMFFIKFF | 0.022 | 971 |
| 21 | VTMLSIFWFN | 0.020 | 972 |
| 238 | TKQIRRAVIK | 0.020 | 973 |

TABLE X

V1B-A3-10mers: 238P1B2

| Pos | 1234567890 | Score | SEQ ID |
|---|---|---|---|
| 42 | ALLGNSLILF | 13.500 | 974 |
| 58 | SLHEPMYYFL | 2.700 | 975 |
| 28 | HTWISIPFCF | 2.250 | 976 |
| 17 | LLTGVPGLEA | 0.900 | 977 |
| 43 | LLGNSLILFA | 0.600 | 978 |
| 5 | TLQNITSTSI | 0.600 | 979 |
| 23 | GLEAFHTWIS | 0.360 | 980 |
| 49 | ILFATITQPS | 0.300 | 981 |
| 9 | ITSTSIIFLL | 0.203 | 982 |
| 8 | NITSTSIIFL | 0.180 | 983 |
| 18 | LTGVPGLEAF | 0.150 | 984 |
| 20 | GVPGLEAFHT | 0.135 | 985 |
| 55 | TQPSLHEPMY | 0.120 | 986 |
| 56 | QPSLHEPMYY | 0.080 | 987 |
| 39 | SVTALLGNSL | 0.060 | 988 |
| 47 | SLILFATITQ | 0.060 | 989 |
| 37 | FLSVTALLGN | 0.060 | 990 |
| 32 | SIPFCFLSVT | 0.045 | 991 |
| 35 | FCFLSVTALL | 0.045 | 992 |
| 62 | PMYYFLSMLS | 0.040 | 993 |
| 30 | WISIPFCFLS | 0.036 | 994 |
| 40 | VTALLGNSLI | 0.030 | 995 |
| 6 | LQNITSTSII | 0.018 | 996 |
| 41 | TALLGNSLIL | 0.018 | 997 |
| 54 | ITQPSLHEPM | 0.015 | 998 |
| 16 | FLLTGVPGLE | 0.013 | 999 |
| 31 | ISIPFCFLSV | 0.013 | 1000 |
| 61 | EPMYYFLSML | 0.012 | 1001 |
| 7 | QNITSTSIIF | 0.012 | 1002 |
| 45 | GNSLILFATI | 0.011 | 1003 |
| 60 | HEPMYYFLSM | 0.011 | 1004 |
| 57 | PSLHEPMYYF | 0.010 | 1005 |
| 1 | FITSTLQNIT | 0.010 | 1006 |
| 14 | IIFLLTGVPG | 0.010 | 1007 |
| 33 | IPFCFLSVTA | 0.010 | 1008 |
| 11 | STSIIFLLTG | 0.009 | 1009 |
| 26 | AFHTWISIPF | 0.006 | 1010 |
| 21 | VPGLEAFHTW | 0.006 | 1011 |
| 10 | TSTSIIFLLT | 0.005 | 1012 |
| 52 | ATITQPSLHE | 0.005 | 1013 |
| 4 | STLQNITSTS | 0.005 | 1014 |
| 48 | LILFATITQP | 0.005 | 1015 |
| 29 | TWISIPFCFL | 0.004 | 1016 |

TABLE X-continued

V1B-A3-10mers: 238P1B2

| Pos | 1234567890 | Score | SEQ ID |
|---|---|---|---|
| 2 | ITSTLQNITS | 0.004 | 1017 |
| 24 | LEAFHTWISI | 0.004 | 1018 |
| 53 | TITQPSLHEP | 0.003 | 1019 |
| 15 | IFLLTGVPGL | 0.003 | 1020 |
| 46 | NSLILFATIT | 0.002 | 1021 |
| 12 | TSIIFLLTGV | 0.002 | 1022 |
| 51 | FATITQPSLH | 0.002 | 1023 |
| 25 | EAFHTWISIP | 0.001 | 1024 |
| 13 | SIIFLLTGVP | 0.001 | 1025 |
| 3 | TSTLQNITST | 0.001 | 1026 |
| 44 | LGNSLILFAT | 0.001 | 1027 |
| 50 | LFATITQPSL | 0.001 | 1028 |
| 59 | LHEPMYYFLS | 0.001 | 1029 |
| 19 | TGVPGLEAFH | 0.000 | 1030 |
| 22 | PGLEAFHTWI | 0.000 | 1031 |
| 27 | FHTWISIPFC | 0.000 | 1032 |
| 34 | PFCFLSVTAL | 0.000 | 1033 |
| 38 | LSVTALLGNS | 0.000 | 1034 |
| 36 | CFLSVTALLG | 0.000 | 1035 |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE X-continued

V1B-A3-10mers: 238P1B2

| Pos | 1234567890 | Score | SEQ ID |
|---|---|---|---|
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE X

V2-A3-10mers: 238P1B2

| Pos | 1234567890 | Score | SEQ ID |
|---|---|---|---|
| 1 | TMIANTYLLT | 0.300 | 1036 |
| 8 | LLTSPLMNPV | 0.300 | 1037 |
| 7 | YLLTSPLMNP | 0.135 | 1038 |
| 5 | NTYLLTSPLM | 0.050 | 1039 |
| 9 | LTSPLMNPVI | 0.045 | 1040 |
| 2 | MIANTYLLTS | 0.036 | 1041 |
| 10 | TSPLMNPVIY | 0.020 | 1042 |
| 4 | ANTYLLTSPL | 0.001 | 1043 |
| 3 | IANTYLLTSP | 0.000 | 1044 |
| 6 | TYLLTSPLMN | 0.000 | 1045 |

TABLE XI

V1-A11-9mers: 238P1B2

| Pos | 123456789 | Score | SEQ ID |
|---|---|---|---|
| 244 | AVIKILHSK | 3.000 | 1046 |
| 239 | KQIRRAVIK | 2.700 | 1047 |
| 169 | SVASPEERK | 2.000 | 1048 |
| 39 | CLSHMFFIK | 1.200 | 1049 |
| 235 | SVKTKQIRR | 0.800 | 1050 |
| 65 | FVAVSNPLR | 0.400 | 1051 |
| 120 | YCYHPDVMK | 0.400 | 1052 |
| 56 | VLLAMAFDR | 0.360 | 1053 |
| 157 | LLSYVLIIR | 0.160 | 1054 |
| 99 | TPMVALLIR | 0.160 | 1055 |
| 231 | PVIYSVKTK | 0.150 | 1056 |
| 150 | GVDLLLILL | 0.120 | 1057 |
| 200 | LSIVHRFGK | 0.090 | 1058 |
| 197 | LISLSIVHR | 0.080 | 1059 |
| 74 | YAMILTDSR | 0.080 | 1060 |
| 85 | QIGVASVIR | 0.080 | 1061 |
| 30 | NVREISFNA | 0.060 | 1062 |
| 21 | VTMLSIFWF | 0.060 | 1063 |
| 114 | QVLHHSYCY | 0.060 | 1064 |
| 90 | SVIRGLLML | 0.060 | 1065 |
| 148 | TVGVDLLLI | 0.040 | 1066 |
| 20 | LVTMLSIFW | 0.040 | 1067 |
| 187 | IVAFAIYYI | 0.040 | 1068 |
| 50 | TVMESSVLL | 0.040 | 1069 |
| 229 | MNPVIYSVK | 0.040 | 1070 |
| 147 | STVGVDLLL | 0.030 | 1071 |
| 18 | STLVTMLSI | 0.030 | 1072 |
| 160 | YVLIIRTVL | 0.030 | 1073 |
| 215 | HTMIANTYL | 0.020 | 1074 |
| 181 | STCVSHIVA | 0.020 | 1075 |
| 220 | NTYLLISPL | 0.020 | 1076 |
| 98 | LTPMVALLI | 0.020 | 1077 |
| 183 | CVSHIVAFA | 0.020 | 1078 |
| 94 | GLLMLTPMV | 0.018 | 1079 |
| 95 | LLMLTPMVA | 0.016 | 1080 |
| 2 | YYFLSMLSA | 0.016 | 1081 |
| 192 | IYYIPLISL | 0.016 | 1082 |
| 49 | FTVMESSVL | 0.015 | 1083 |
| 43 | MFFIKFFTV | 0.012 | 1084 |
| 23 | MLSIFWFNV | 0.012 | 1085 |
| 59 | AMAFDRFVA | 0.012 | 1086 |
| 128 | KLSCTDTRI | 0.012 | 1087 |
| 141 | GLTAMFSTV | 0.012 | 1088 |
| 154 | LLILLSYVL | 0.012 | 1089 |
| 186 | HIVAFAIYY | 0.012 | 1090 |
| 104 | LLIRLSYCH | 0.012 | 1091 |
| 107 | RLSYCHSQV | 0.012 | 1092 |
| 162 | LIIRTVLSV | 0.012 | 1093 |
| 216 | TMIANTYLL | 0.012 | 1094 |
| 156 | ILLSYVLII | 0.012 | 1095 |
| 131 | CTDTRINSA | 0.010 | 1096 |
| 78 | LTDSRIAQI | 0.010 | 1097 |
| 202 | IVHRFGKQA | 0.010 | 1098 |
| 38 | ACLSHMFFI | 0.009 | 1099 |
| 64 | RFVAVSNPL | 0.009 | 1100 |
| 84 | AQIGVASVI | 0.009 | 1101 |
| 217 | MIANTYLLI | 0.008 | 1102 |
| 7 | MLSATDLGL | 0.008 | 1103 |
| 240 | QIRRAVIKI | 0.008 | 1104 |
| 194 | YIPLISLSI | 0.008 | 1105 |
| 228 | LMNPVTYSV | 0.008 | 1106 |
| 121 | CYHPDVMKL | 0.008 | 1107 |
| 51 | VMESSVLLA | 0.008 | 1108 |
| 168 | LSVASPEER | 0.006 | 1109 |
| 127 | MKLSCTDTR | 0.006 | 1110 |
| 234 | YSVKTKQIR | 0.006 | 1111 |
| 24 | LSIFWFNVR | 0.006 | 1112 |
| 87 | GVASVIRGL | 0.006 | 1113 |
| 19 | TLVTMLSIF | 0.006 | 1114 |
| 205 | RFGKQAPAY | 0.006 | 1115 |
| 221 | TYLLISPLM | 0.006 | 1116 |
| 70 | NPLRYAMIL | 0.006 | 1117 |
| 155 | LILLSYVLI | 0.006 | 1118 |
| 178 | ETFSTCVSH | 0.006 | 1119 |

TABLE XI-continued

V1-A11-9mers: 238P1B2

| Pos | 123456789 | Score | SEQ ID |
|---|---|---|---|
| 75 | AMILTDSRI | 0.006 | 1120 |
| 66 | VAVSNPLRY | 0.006 | 1121 |
| 102 | VALLIRLSY | 0.006 | 1122 |
| 96 | LMLTPMVAL | 0.006 | 1123 |
| 153 | LLLILLSYV | 0.006 | 1124 |
| 165 | RTVLSVASP | 0.005 | 1125 |
| 57 | LLAMAFDRF | 0.004 | 1126 |
| 28 | WFNVREISF | 0.004 | 1127 |
| 163 | IIRTVLSVA | 0.004 | 1128 |
| 139 | AVGLTAMFS | 0.004 | 1129 |
| 143 | TAMFSTVGV | 0.004 | 1130 |
| 60 | MAFDRFVAV | 0.004 | 1131 |
| 16 | SISTLVTML | 0.004 | 1132 |
| 110 | YCHSQVLHH | 0.004 | 1133 |
| 37 | NACLSHMFF | 0.004 | 1134 |
| 109 | SYCHSQVLH | 0.004 | 1135 |
| 119 | SYCYHPDVM | 0.004 | 1136 |
| 189 | AFAIYYIPL | 0.004 | 1137 |
| 9 | SATDLGLSI | 0.004 | 1138 |
| 224 | LISPLMNPV | 0.004 | 1139 |
| 115 | VLHHSYCYH | 0.004 | 1140 |
| 97 | MLTPMVALL | 0.004 | 1141 |
| 152 | DLLLILLSY | 0.004 | 1142 |
| 237 | KTKQIRRAV | 0.003 | 1143 |
| 55 | SVLLAMAFD | 0.003 | 1144 |
| 138 | SAVGLTAMF | 0.003 | 1145 |

TABLE XI

V1B-A11-9mers: 238P1B2

| Pos | 123456789 | Score | SEQ ID |
|---|---|---|---|
| 20 | GVPGLEAFH | 0.060 | 1146 |
| 9 | ITSTSIIFL | 0.020 | 1147 |
| 18 | LTGVPGLEA | 0.020 | 1148 |
| 52 | ATITQPSLH | 0.015 | 1149 |
| 42 | ALLGNSLIL | 0.012 | 1150 |
| 23 | GLEAFHTWI | 0.012 | 1151 |

TABLE XI-continued

V1B-A11-9mers: 238P1B2

| Pos | 123456789 | Score | SEQ ID |
|---|---|---|---|
| 40 | VTALLGNSL | 0.010 | 1152 |
| 43 | LLGNSLILF | 0.008 | 1153 |
| 8 | NITSTSIIF | 0.008 | 1154 |
| 58 | SLHEPMYYF | 0.008 | 1155 |
| 32 | SIPFCFLSV | 0.008 | 1156 |
| 55 | TQPSLHEPM | 0.006 | 1157 |
| 6 | LQNITSTSI | 0.006 | 1158 |
| 16 | FLLTGVPGL | 0.006 | 1159 |
| 13 | SIIFLLTGV | 0.006 | 1160 |
| 1 | FITSTLQNI | 0.004 | 1161 |
| 35 | FCFLSVTAL | 0.004 | 1162 |
| 30 | WISIPFCFL | 0.004 | 1163 |
| 41 | TALLGNSLI | 0.003 | 1164 |
| 36 | CFLSVTALL | 0.003 | 1165 |
| 25 | EAFHTWISI | 0.002 | 1166 |
| 61 | EPMYYFLSM | 0.002 | 1167 |
| 51 | FATITQPSL | 0.002 | 1168 |
| 39 | SVTALLGNS | 0.002 | 1169 |
| 56 | QPSLHEPMY | 0.002 | 1170 |
| 28 | HTWISIPFC | 0.002 | 1171 |
| 11 | STSIIFLLT | 0.002 | 1172 |
| 4 | STLQNITST | 0.002 | 1173 |
| 48 | LILFATITQ | 0.001 | 1174 |
| 2 | ITSTLQNIT | 0.001 | 1175 |
| 54 | ITQPSLHEP | 0.001 | 1176 |
| 29 | TWISIPFCF | 0.001 | 1177 |
| 37 | FLSVTALLG | 0.001 | 1178 |
| 14 | IIFLLTGVP | 0.001 | 1179 |
| 62 | PMYYFLSML | 0.001 | 1180 |
| 49 | ILFATITQP | 0.001 | 1181 |
| 53 | TITQPSLHE | 0.001 | 1182 |
| 7 | QNITSTSII | 0.001 | 1183 |
| 47 | SLILFATIT | 0.001 | 1184 |
| 10 | TSTSIIFLL | 0.001 | 1185 |
| 21 | VPGLEAFHT | 0.001 | 1186 |
| 44 | LGNSLILFA | 0.000 | 1187 |
| 59 | LHEPMYYFL | 0.000 | 1188 |

TABLE XI-continued

V1B-A11-9mers: 238P1B2

| Pos | 123456789 | Score | SEQ ID |
|---|---|---|---|
| 5 | TLQNITSTS | 0.000 | 1189 |
| 27 | FHTWISIPF | 0.000 | 1190 |
| 33 | IPFCFLSVT | 0.000 | 1191 |
| 17 | LLTGVPGLE | 0.000 | 1192 |
| 45 | GNSLILFAT | 0.000 | 1193 |
| 19 | TGVPGLEAF | 0.000 | 1194 |
| 46 | NSLILFATI | 0.000 | 1195 |
| 15 | IFLLTGVPG | 0.000 | 1196 |
| 34 | PFCFLSVTA | 0.000 | 1197 |
| 26 | AFHTWISIP | 0.000 | 1198 |
| 50 | LFATITQPS | 0.000 | 1199 |
| 60 | HEPMYYFLS | 0.000 | 1200 |
| 24 | LEAFHTWIS | 0.000 | 1201 |
| 31 | ISTPFCFLS | 0.000 | 1202 |
| 38 | LSVTALLGN | 0.000 | 1203 |
| 57 | PSLHEPMYY | 0.000 | 1204 |
| 12 | TSIIFLLTG | 0.000 | 1205 |
| 3 | TSTLQNITS | 0.000 | 1206 |
| 22 | PGLEAFHTW | 0.000 | 1207 |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XI-continued

V1B-A11-9mers: 238P1B2

| Pos | 123456789 | Score | SEQ ID |
|---|---|---|---|
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XI

V2-A11-9mers

| Pos | 123456789 | Score | SEQ ID |
|---|---|---|---|
| 4 | NTYLLTSPL | 0.020 | 1208 |
| 8 | LTSPLMNPV | 0.010 | 1209 |
| 5 | TYLLTSPLM | 0.006 | 1210 |
| 6 | YLLTSPLMN | 0.001 | 1211 |
| 7 | LLTSPLMNP | 0.001 | 1212 |
| 1 | MIANTYLLT | 0.001 | 1213 |
| 2 | IANTYLLTS | 0.000 | 1214 |
| 9 | TSPLMNPVI | 0.000 | 1215 |
| 3 | ANTYLLTSP | 0.000 | 1216 |

TABLE XII

V1-A11-10-mers: 238P1B2

| Pos | 1234567890 | Score | SEQ ID |
|---|---|---|---|
| 55 | SVLLAMAFDR | 1.800 | 1217 |
| 199 | SLSIVHRFGK | 1.200 | 1218 |
| 38 | ACLSHMFFIK | 0.900 | 1219 |
| 243 | RAVIKILHSK | 0.900 | 1220 |
| 98 | LTPMVALLIR | 0.400 | 1221 |
| 119 | SYCYHPDVMK | 0.400 | 1222 |
| 228 | LMNPVIYSVK | 0.400 | 1223 |
| 73 | RYAMILTDSR | 0.240 | 1224 |
| 156 | ILLSYVLIIR | 0.240 | 1225 |
| 84 | AQIGVASVIR | 0.180 | 1226 |
| 64 | RFVAVSNPLR | 0.180 | 1227 |
| 230 | NPVIYSVKTK | 0.150 | 1228 |
| 233 | IYSVKTKQIR | 0.080 | 1229 |
| 50 | TVMESSVLLA | 0.080 | 1230 |
| 23 | MLSIFWFNVR | 0.080 | 1231 |
| 167 | VLSVASPEER | 0.080 | 1232 |
| 126 | VMKLSCTDTR | 0.080 | 1233 |
| 20 | LVTMLSIFWF | 0.060 | 1234 |
| 87 | GVASVIRGLL | 0.060 | 1235 |
| 183 | CVSHIVAFAI | 0.060 | 1236 |
| 239 | KQIRRAVIKI | 0.054 | 1237 |
| 65 | FVAVSNPLRY | 0.040 | 1238 |
| 101 | MVALLIRLSY | 0.040 | 1239 |
| 67 | AVSNPLRYAM | 0.040 | 1240 |
| 215 | HTMIANTYLL | 0.040 | 1241 |
| 148 | TVGVDLLLIL | 0.040 | 1242 |
| 94 | GLLMLTPMVA | 0.036 | 1243 |
| 168 | LSVASPEERK | 0.030 | 1244 |
| 147 | STVGVDLLLI | 0.030 | 1245 |
| 237 | KTKQIRRAVI | 0.030 | 1246 |
| 114 | QVLHHSYCYH | 0.030 | 1247 |
| 42 | HMFFIKFFTV | 0.024 | 1248 |
| 135 | RINSAVGLTA | 0.024 | 1249 |
| 220 | NTYLLISPLM | 0.020 | 1250 |
| 213 | YVHTMIANTY | 0.020 | 1251 |
| 238 | TKQIRRAVIK | 0.020 | 1252 |
| 113 | SQVLHHSYCY | 0.018 | 1253 |
| 22 | TMLSIFWFNV | 0.018 | 1254 |
| 208 | KQAPAYVHTM | 0.018 | 1255 |
| 191 | AIYYIPLISL | 0.016 | 1256 |
| 1 | MYYFLSMLSA | 0.016 | 1257 |
| 18 | STLVTMLSIF | 0.015 | 1258 |
| 49 | FTVMESSVLL | 0.015 | 1259 |
| 234 | YSVKTKQIRR | 0.012 | 1260 |
| 196 | PLISLSIVHR | 0.012 | 1261 |
| 58 | LAMAFDRFVA | 0.012 | 1262 |
| 150 | GVDLLLILLS | 0.012 | 1263 |
| 216 | TMIANTYLLI | 0.012 | 1264 |
| 193 | YYIPLISLSI | 0.012 | 1265 |
| 155 | LILLSYVLII | 0.012 | 1266 |
| 107 | RLSYCHSQVL | 0.012 | 1267 |
| 186 | HIVAFAIYYI | 0.012 | 1268 |
| 82 | RIAQIGVASV | 0.012 | 1269 |
| 47 | KFFTVMESSV | 0.012 | 1270 |
| 19 | TLVTMLSIFW | 0.012 | 1271 |
| 153 | LLLILLSYVL | 0.012 | 1272 |
| 14 | GLSISTLVTM | 0.012 | 1273 |
| 6 | SMLSATDLGL | 0.012 | 1274 |
| 161 | VLIIRTVLSV | 0.012 | 1275 |
| 103 | ALLIRLSYCH | 0.012 | 1276 |
| 131 | CTDTRINSAV | 0.010 | 1277 |
| 142 | LTAMFSTVGV | 0.010 | 1278 |
| 181 | STCVSHIVAF | 0.010 | 1279 |
| 109 | SYCHSQVLHH | 0.008 | 1280 |
| 144 | AMFSTVGVDL | 0.008 | 1281 |
| 39 | CLSHMFFIKF | 0.008 | 1282 |
| 97 | MLTPMVALLI | 0.008 | 1283 |
| 120 | YCYHPDVMKL | 0.008 | 1284 |
| 51 | VMESSVLLAM | 0.008 | 1285 |
| 95 | LLMLTPMVAL | 0.008 | 1286 |
| 188 | VAFAIYYIPL | 0.008 | 1287 |
| 99 | TPMVALLIRL | 0.008 | 1288 |
| 223 | LLISPLMNPV | 0.006 | 1289 |
| 159 | SYVLIIRTVL | 0.006 | 1290 |

TABLE XII-continued

V1-A11-10-mers: 238P1B2

| Pos | 1234567890 | Score | SEQ ID |
|---|---|---|---|
| 154 | LLILLSYVLI | 0.006 | 1291 |
| 162 | LIIRTVLSVA | 0.006 | 1292 |
| 37 | NACLSHMFFI | 0.006 | 1293 |
| 205 | RFGKQAPAYV | 0.006 | 1294 |
| 178 | ETFSTCVSHI | 0.006 | 1295 |
| 139 | AVGLTAMFST | 0.006 | 1296 |
| 90 | SVIRGLLMLT | 0.006 | 1297 |
| 56 | VLLAMAFDRF | 0.006 | 1298 |
| 96 | LMLTPMVALL | 0.006 | 1299 |
| 195 | IPLISLSIVH | 0.006 | 1300 |
| 165 | RTVLSVASPE | 0.005 | 1301 |
| 21 | VTMLSIFWFN | 0.004 | 1302 |
| 197 | LISLSIVHRF | 0.004 | 1303 |
| 232 | VIYSVKTKQI | 0.004 | 1304 |
| 74 | YAMILTDSRI | 0.004 | 1305 |
| 43 | MFFIKFFTVM | 0.004 | 1306 |
| 187 | IVAFAIYYIP | 0.004 | 1307 |
| 4 | FLSMLSATDL | 0.004 | 1308 |
| 77 | ILTDSRIAQI | 0.004 | 1309 |
| 194 | YIPLISLSIV | 0.004 | 1310 |
| 224 | LISPLMNPVI | 0.004 | 1311 |
| 210 | APAYVHTMIA | 0.004 | 1312 |
| 88 | VASVIRGLLM | 0.004 | 1313 |
| 59 | AMAFDRFVAV | 0.004 | 1314 |
| 201 | SIVHRFGKQA | 0.003 | 1315 |
| 160 | YVLIIRTVLS | 0.003 | 1316 |

TABLE XII

V1B-A11-10mers

| Pos | 1234567890 | Score | SEQ ID |
|---|---|---|---|
| 28 | HTWISIPFCF | 0.060 | 1317 |
| 9 | ITSTSIIFLL | 0.030 | 1318 |
| 39 | SVTALLGNSL | 0.020 | 1319 |
| 20 | GVPGLEAFHT | 0.018 | 1320 |
| 42 | ALLGNSLILF | 0.012 | 1321 |
| 40 | VTALLGNSLI | 0.010 | 1323 |

TABLE XII-continued

V1B-A11-10mers

| Pos | 1234567890 | Score | SEQ ID |
|---|---|---|---|
| 54 | ITQPSLHEPM | 0.010 | 1323 |
| 18 | LTGVPGLEAF | 0.010 | 1324 |
| 8 | NITSTSIIFL | 0.008 | 1325 |
| 58 | SLHEPMYYFL | 0.008 | 1326 |
| 17 | LLTGVPGLEA | 0.008 | 1327 |
| 43 | LLGNSLILFA | 0.008 | 1328 |
| 55 | TQPSLHEPMY | 0.006 | 1329 |
| 6 | LQNITSTSII | 0.006 | 1330 |
| 41 | TALLGNSLIL | 0.006 | 1331 |
| 33 | IPFCFLSVTA | 0.004 | 1333 |
| 56 | QPSLHEPMYY | 0.004 | 1333 |
| 26 | AFHTWISIPF | 0.004 | 1334 |
| 5 | TLQNITSTSI | 0.004 | 1335 |
| 35 | FCFLSVTALL | 0.004 | 1336 |
| 15 | IFLLTGVPGL | 0.003 | 1337 |
| 52 | ATITQPSLHE | 0.003 | 1338 |
| 23 | GLEAFHTWIS | 0.002 | 1339 |
| 50 | LFATITQPSL | 0.002 | 1340 |
| 51 | FATITQPSLH | 0.002 | 1341 |
| 11 | STSIIFLLTG | 0.002 | 1342 |
| 2 | ITSTLQNITS | 0.002 | 1343 |
| 21 | VPGLEAFHTW | 0.002 | 1344 |
| 4 | STLQNITSTS | 0.002 | 1345 |
| 47 | SLILFATITQ | 0.001 | 1346 |
| 7 | QNITSTSIIF | 0.001 | 1347 |
| 30 | WISIPFCFLS | 0.001 | 1348 |
| 45 | GNSLILFATI | 0.001 | 1349 |
| 24 | LEAFHTWISI | 0.001 | 1350 |
| 60 | HEPMYYFLSM | 0.001 | 1351 |
| 61 | EPMYYFLSML | 0.001 | 1352 |
| 49 | ILFATITQPS | 0.001 | 1353 |
| 14 | IIFLLTGVPG | 0.001 | 1354 |
| 37 | FLSVTALLGN | 0.001 | 1355 |
| 48 | LILFATITQP | 0.001 | 1356 |
| 36 | CFLSVTALLG | 0.001 | 1357 |
| 16 | FLLTGVPGLE | 0.001 | 1358 |
| 31 | ISIPFCFLSV | 0.001 | 1359 |

TABLE XII-continued

V1B-A11-10mers

| Pos | 1234567890 | Score | SEQ ID |
|---|---|---|---|
| 13 | SIIFLLTGVP | 0.001 | 1360 |
| 1 | FITSTLQNIT | 0.000 | 1361 |
| 32 | SIPFCFLSVT | 0.000 | 1362 |
| 53 | TITQPSLHEP | 0.000 | 1363 |
| 29 | TWISIPFCFL | 0.000 | 1364 |
| 19 | TGVPGLEAFH | 0.000 | 1365 |
| 12 | TSIIFLLTGV | 0.000 | 1366 |
| 34 | PFCFLSVTAL | 0.000 | 1367 |
| 62 | PMYYFLSMLS | 0.000 | 1368 |
| 25 | EAFHTWISIP | 0.000 | 1369 |
| 57 | PSLHEPMYYF | 0.000 | 1370 |
| 44 | LGNSLILFAT | 0.000 | 1371 |
| 59 | LHEPMYYFLS | 0.000 | 1372 |
| 10 | TSTSIIFLLT | 0.000 | 1373 |
| 22 | PGLEAFHTWI | 0.000 | 1374 |
| 38 | LSVTALLGNS | 0.000 | 1375 |
| 46 | NSLILFATIT | 0.000 | 1376 |
| 27 | FHTWISIPFC | 0.000 | 1377 |
| 3 | TSTLQNITST | 0.000 | 1378 |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |
| 0 | | 0.000 | |

TABLE XII

V2-A11-10mers: 238P1B2

| Pos | 1234567890 | Score | SEQ ID |
|---|---|---|---|
| 5 | NTYLLTSPLM | 0.020 | 1379 |
| 9 | LTSPLMNPVI | 0.010 | 1380 |
| 8 | LLTSPLMNPV | 0.004 | 1381 |
| 7 | YLLTSPLMNP | 0.001 | 1382 |
| 6 | TYLLTSPLMN | 0:001 | 1383 |
| 1 | TMIANTYLLT | 0.001 | 1384 |
| 2 | MIANTYLLTS | 0.001 | 1385 |
| 4 | ANTYLLTSPL | 0.000 | 1386 |
| 3 | IANTYLLTSP | 0.000 | 1387 |
| 10 | TSPLMNPVIY | 0.000 | 1388 |

TABLE XIII

V1-A24-9-mers: 238P1B2

| Pos | 123456789 | Score | SEQ ID |
|---|---|---|---|
| 121 | CYHPDVMKL | 264.000 | 1389 |
| 192 | IYYIPLISL | 200.000 | 1390 |
| 64 | RFVAVSNPL | 100.800 | 1391 |
| 221 | TYLLISPLM | 52.500 | 1392 |
| 233 | IYSVKTKQI | 50.000 | 1393 |
| 145 | MFSTVGVDL | 28.000 | 1394 |
| 119 | SYCHPDVM | 25.000 | 1395 |
| 189 | AFAIYYIPL | 20.000 | 1396 |
| 28 | WFNVREISF | 15.000 | 1397 |
| 73 | RYAMILTDS | 14.000 | 1398 |
| 193 | YYIPLISLS | 10.800 | 1399 |
| 159 | SYVLIIRTV | 10.500 | 1400 |
| 149 | VGVDLLLIL | 8.640 | 1401 |
| 147 | STVGVDLLL | 8.400 | 1402 |
| 160 | YVLIIRTVL | 8.400 | 1403 |
| 212 | AYVHTMIAN | 7.500 | 1404 |
| 154 | LLILLSYVL | 7.200 | 1405 |
| 50 | TVMESSVLL | 7.200 | 1406 |
| 96 | LMLTPMVAL | 6.000 | 1407 |
| 5 | LSMLSATDL | 6.000 | 1408 |
| 216 | TMIANTYLL | 6.000 | 1409 |
| 49 | FTVMESSVL | 6.000 | 1410 |
| 70 | NPLRYAMIL | 6.000 | 1411 |
| 1 | MYYFLSMLS | 6.000 | 1412 |
| 215 | HTMIANTYL | 6.000 | 1413 |
| 90 | SVIRGLLML | 6.000 | 1414 |
| 88 | VASVIRGLL | 5.600 | 1415 |
| 87 | GVASVIRGL | 5.600 | 1416 |
| 26 | IFWFNVREI | 5.500 | 1417 |
| 179 | TFSTCVSHI | 5.000 | 1418 |
| 2 | YYFLSMLSA | 5.000 | 1419 |
| 16 | SISTLVTML | 4.800 | 1420 |
| 108 | LSYCHSQVL | 4.800 | 1421 |
| 97 | MLTPMVALL | 4.800 | 1422 |
| 150 | GVDLLLILL | 4.800 | 1423 |
| 220 | NTYLLISPL | 4.800 | 1424 |
| 44 | FFIKFFTVM | 4.500 | 1425 |
| 198 | ISLSIVHRF | 4.200 | 1426 |
| 146 | FSTVGVDLL | 4.000 | 1427 |
| 7 | MLSATDLGL | 4.000 | 1428 |
| 12 | DLGLSISTL | 4.000 | 1429 |
| 35 | SFNACLSHM | 3.750 | 1430 |
| 138 | SAVGLTAMF | 3.600 | 1431 |
| 172 | SPEERKETF | 3.600 | 1432 |
| 54 | SSVLLAMAF | 3.600 | 1433 |
| 21 | VTMLSIFWF | 3.000 | 1434 |
| 182 | TCVSHIVAF | 3.000 | 1435 |
| 19 | TLVTMLSIF | 3.000 | 1436 |
| 40 | LSHMFFIKF | 2.640 | 1437 |
| 57 | LLAMAFDRF | 2.400 | 1438 |
| 36 | FNACLSHMF | 2.400 | 1439 |
| 98 | LTPMVALLI | 2.100 | 1440 |
| 194 | YIPLISLSI | 2.100 | 1441 |
| 84 | AQIGVASVI | 2.100 | 1442 |
| 128 | KLSCTDTRI | 2.000 | 1443 |
| 37 | NACLSHMFF | 2.000 | 1444 |
| 190 | FAIYYIPLI | 1.500 | 1445 |
| 156 | ILLSYVLII | 1.500 | 1446 |
| 69 | SNPLRYAMI | 1.500 | 1447 |
| 75 | AMILTDSRI | 1.500 | 1448 |
| 225 | ISPLMNPVI | 1.500 | 1449 |
| 18 | STLVTMLSI | 1.500 | 1450 |
| 155 | LILLSYVLI | 1.500 | 1451 |
| 93 | RGLLMLTPM | 1.500 | 1452 |
| 38 | ACLSHMFFI | 1.500 | 1453 |
| 9 | SATDLGLSI | 1.440 | 1454 |
| 47 | KFFTVMESS | 1.400 | 1455 |
| 210 | APAYVHTMI | 1.400 | 1456 |
| 184 | VSHIVAFAI | 1.400 | 1457 |
| 32 | REISFNACL | 1.200 | 1458 |
| 240 | QIRRAVIKI | 1.100 | 1459 |
| 68 | VSNPLRYAM | 1.080 | 1460 |
| 205 | RFGKQAPAY | 1.000 | 1461 |
| 217 | MIANTYLLI | 1.000 | 1462 |

TABLE XIII-continued

V1-A24-9mers: 238P1B2

| Pos | 123456789 | Score | SEQ ID |
|---|---|---|---|
| 187 | IVAFAIYYI | 1.000 | 1463 |
| 148 | TVGVDLLLI | 1.000 | 1464 |
| 78 | LTDSRIAQI | 1.000 | 1465 |
| 89 | ASVIRGLLM | 0.750 | 1466 |
| 3 | YFLSMLSAT | 0.750 | 1467 |
| 209 | QAPAYVHTM | 0.750 | 1468 |
| 15 | LSISTLVTM | 0.750 | 1469 |
| 100 | PMVALLIRL | 0.720 | 1470 |
| 134 | TRINSAVGL | 0.600 | 1471 |
| 43 | MFFIKFFTV | 0.600 | 1472 |
| 241 | IRRAVIKIL | 0.560 | 1473 |
| 48 | FFTVMESSV | 0.500 | 1474 |
| 137 | NSAVGLTAM | 0.500 | 1475 |
| 61 | AFDRFVAVS | 0.500 | 1476 |
| 109 | SYCHSQVLH | 0.500 | 1477 |
| 243 | RAVIKILHS | 0.300 | 1478 |
| 41 | SHMFFIKFF | 0.300 | 1479 |
| 135 | RINSAVGLT | 0.300 | 1480 |
| 237 | KTKQIRRAV | 0.280 | 1481 |
| 82 | RIAQIGVAS | 0.280 | 1482 |
| 22 | TMLSIFWFN | 0.252 | 1483 |
| 228 | LMNPVIYSV | 0.252 | 1484 |
| 208 | KQAPAYVHT | 0.240 | 1485 |
| 152 | DLLLILLSY | 0.210 | 1486 |
| 13 | LGLSISTLV | 0.210 | 1487 |
| 102 | VALLIRLSY | 0.210 | 1488 |

TABLE XIII

V1B-A24-9mers: 238P1B2

| Pos | 123456789 | Score | SEQ ID |
|---|---|---|---|
| 36 | CFLSVTALL | 42.000 | 1489 |
| 42 | ALLGNSLIL | 6.000 | 1490 |
| 16 | FLLTGVPGL | 6.000 | 1491 |
| 40 | VTALLGNSL | 5.760 | 1492 |
| 10 | TSTSIIFLL | 5.600 | 1493 |
| 30 | WISIPFCFL | 4.800 | 1494 |

TABLE XIII-continued

V1B-A24-9mers: 238P1B2

| Pos | 123456789 | Score | SEQ ID |
|---|---|---|---|
| 29 | TWISIPFCF | 4.200 | 1495 |
| 51 | FATITQPSL | 4.000 | 1496 |
| 9 | ITSTSIIFL | 4.000 | 1497 |
| 35 | FCFLSVTAL | 4.000 | 1498 |
| 19 | TGVPGLEAF | 3.600 | 1499 |
| 58 | SLHEPMYYF | 2.400 | 1500 |
| 46 | NSLILFATI | 2.160 | 1501 |
| 43 | LLGNSLILF | 2.000 | 1502 |
| 8 | NITSTSIIF | 2.000 | 1503 |
| 7 | QNITSTSII | 1.500 | 1504 |
| 41 | TALLGNSLI | 1.500 | 1505 |
| 6 | LQNITSTSI | 1.500 | 1506 |
| 23 | GLEAFHTWI | 1.500 | 1507 |
| 1 | FITSTLQNI | 1.200 | 1508 |
| 25 | EAFHTWISI | 1.000 | 1509 |
| 61 | EPMYYFLSM | 0.900 | 1510 |
| 55 | TQPSLHEPM | 0.900 | 1511 |
| 50 | LFATITQPS | 0.840 | 1512 |
| 59 | LHEPMYYFL | 0.720 | 1513 |
| 62 | PMYYFLSML | 0.400 | 1514 |
| 27 | FHTWISIPF | 0.280 | 1515 |
| 5 | TLQNITSTS | 0.210 | 1516 |
| 31 | ISIPFCFLS | 0.180 | 1517 |
| 44 | LGNSLILFA | 0.180 | 1518 |
| 13 | STIFLLTGV | 0.180 | 1519 |
| 32 | SIPFCFLSV | 0.180 | 1520 |
| 11 | STSIIFLLT | 0.168 | 1521 |
| 47 | SLILFATIT | 0.150 | 1522 |
| 4 | STLQNITST | 0.150 | 1523 |
| 38 | LSVTALLGN | 0.150 | 1524 |
| 2 | ITSTLQNIT | 0.144 | 1525 |
| 45 | GNSLILFAT | 0.140 | 1526 |
| 39 | SVTALLGNS | 0.120 | 1527 |
| 18 | LTGVPGLEA | 0.110 | 1528 |
| 56 | QPSLHEPMY | 0.100 | 1529 |
| 28 | HTWISIPFC | 0.100 | 1530 |
| 3 | TSTLQNITS | 0.100 | 1531 |

TABLE XIII-continued

V1B-A24-9mers: 238P1B2

| Pos | 123456789 | Score | SEQ ID |
|---|---|---|---|
| 33 | IPFCFLSVT | 0.100 | 1532 |
| 21 | VPGLEAFHT | 0.100 | 1533 |
| 15 | IFLLTGVPG | 0.075 | 1534 |
| 34 | PFCFLSVTA | 0.060 | 1535 |
| 26 | AFHTWISIP | 0.050 | 1536 |
| 22 | PGLEAFHTW | 0.022 | 1537 |
| 54 | ITQPSLHEP | 0.020 | 1538 |
| 20 | GVPGLEAFH | 0.018 | 1539 |
| 12 | TSIIFLLTG | 0.015 | 1540 |
| 48 | LILFATITQ | 0.015 | 1541 |
| 57 | PSLHEPMYY | 0.015 | 1542 |
| 52 | ATITQPSLH | 0.015 | 1543 |
| 60 | HEPMYYFLS | 0.015 | 1544 |
| 17 | LLTGVPGLE | 0.014 | 1545 |
| 14 | IIFLLTGVP | 0.012 | 1546 |
| 24 | LEAFHTWIS | 0.010 | 1547 |
| 49 | ILFATITQP | 0.010 | 1548 |
| 37 | FLSVTALLG | 0.010 | 1549 |
| 53 | TITQPSLHE | 0.010 | 1550 |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XIII-continued

V1B-A24-9mers: 238P1B2

| Pos | 123456789 | Score | SEQ ID |
|---|---|---|---|
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XIII

V2-A24-9mers

| Pos | 123456789 | Score | SEQ ID |
|---|---|---|---|
| 5 | TYLLTSPLM | 37.500 | 1551 |
| 4 | NTYLLTSPL | 4.800 | 1552 |
| 9 | TSPLMNPVI | 1.500 | 1553 |
| 8 | LTSPLMNPV | 0.173 | 1554 |
| 6 | YLLTSPLMN | 0.150 | 1555 |
| 2 | IANTYLLTS | 0.150 | 1556 |
| 1 | MIANTYLLT | 0.100 | 1557 |
| 3 | ANTYLLTSP | 0.012 | 1558 |
| 7 | LLTSPLMNP | 0.010 | 1559 |

TABLE XIV

V1-A24-10mers: 238P1B2

| Pos | 1234567890 | Score | SEQ ID |
|---|---|---|---|
| 159 | SYVLIIRTVL | 420.000 | 1560 |
| 193 | YYIPLISLSI | 126.000 | 1561 |
| 145 | MFSTVGVDLL | 20.000 | 1562 |
| 48 | FFTVMESSVL | 20.000 | 1563 |
| 35 | SFNACLSHMF | 18.000 | 1564 |
| 107 | RLSYCHSQVL | 9.600 | 1565 |
| 149 | VGVDLLLILL | 8.640 | 1566 |
| 121 | CYHPDVMKLS | 8.400 | 1567 |
| 86 | IGVASVIRGL | 8.400 | 1568 |
| 221 | TYLLISPLMN | 7.500 | 1569 |
| 212 | AYVHTMIANT | 7.500 | 1570 |
| 99 | TPMVALLIRL | 7.200 | 1571 |
| 15 | LSISTLVTML | 7.200 | 1572 |
| 153 | LLLILLSYVL | 7.200 | 1573 |
| 6 | SMLSATDLGL | 6.000 | 1574 |
| 49 | FTVMESSVLL | 6.000 | 1575 |
| 69 | SNPLRYAMIL | 6.000 | 1576 |
| 96 | LMLTPMVALL | 6.000 | 1577 |
| 89 | ASVIRGLLML | 6.000 | 1578 |
| 95 | LLMLTPMVAL | 6.000 | 1579 |
| 192 | IYYIPLISLS | 6.000 | 1580 |
| 215 | HTMIANTYLL | 6.000 | 1581 |
| 144 | AMFSTVGVDL | 5.600 | 1582 |
| 146 | FSTVGVDLLL | 5.600 | 1583 |
| 240 | QIRRAVIKIL | 5.600 | 1584 |
| 87 | GVASVIRGLL | 5.600 | 1585 |
| 2 | YYFLSMLSAT | 5.000 | 1586 |
| 1 | MYYFLSMLSA | 5.000 | 1587 |
| 189 | AFAIYYIPLI | 5.000 | 1588 |
| 219 | ANTYLLISPL | 4.800 | 1589 |
| 148 | TVGVDLLLIL | 4.800 | 1590 |
| 120 | YCYHPDVMKL | 4.400 | 1591 |
| 133 | DTRINSAVGL | 4.000 | 1592 |
| 188 | VAFAIYYIPL | 4.000 | 1593 |
| 4 | FLSMLSATDL | 4.000 | 1594 |
| 191 | AIYYIPLISL | 4.000 | 1595 |
| 56 | VLLAMAFDRF | 3.600 | 1596 |
| 171 | ASPEERKETF | 3.600 | 1597 |
| 239 | KQIRRAVIKI | 3.300 | 1598 |
| 43 | MFFIKFFTVM | 3.000 | 1599 |
| 18 | STLVTMLSIF | 3.000 | 1600 |
| 197 | LISLSIVHRF | 2.800 | 1601 |
| 39 | CLSHMFFIKF | 2.640 | 1602 |
| 53 | ESSVLLAMAF | 2.400 | 1603 |
| 137 | NSAVGLTAMF | 2.400 | 1604 |
| 209 | QAPAYVHTMI | 2.100 | 1605 |
| 83 | IAQIGVASVI | 2.100 | 1606 |
| 237 | KTKQIRRAVI | 2.000 | 1607 |
| 36 | FNACLSHMFF | 2.000 | 1608 |
| 181 | STCVSHIVAF | 2.000 | 1609 |
| 27 | FWFNVREISF | 2.000 | 1610 |
| 40 | LSHMFFIKFF | 2.000 | 1611 |
| 20 | LVTMLSIFWF | 2.000 | 1612 |
| 68 | VSNPLRYAMI | 1.800 | 1613 |
| 97 | MLTPMVALLI | 1.680 | 1614 |
| 74 | YAMILTDSRI | 1.500 | 1615 |
| 154 | LLILLSYVLI | 1.500 | 1616 |
| 155 | LILLSYVLII | 1.500 | 1617 |
| 186 | HIVAFAIYYI | 1.500 | 1618 |
| 147 | STVGVDLLLI | 1.500 | 1619 |
| 216 | TMIANTYLLI | 1.500 | 1620 |
| 183 | CVSHIVAFAI | 1.400 | 1621 |
| 224 | LISPLMNPVI | 1.200 | 1622 |
| 77 | ILTDSRIAQI | 1.200 | 1623 |
| 8 | LSATDLGLSI | 1.200 | 1624 |
| 208 | KQAPAYVHTM | 1.200 | 1625 |
| 73 | RYAMILTDSR | 1.200 | 1626 |
| 25 | SIFWFNVREI | 1.100 | 1627 |
| 51 | VMESSVLLAM | 1.050 | 1628 |
| 232 | VIYSVKTKQI | 1.000 | 1629 |
| 178 | ETFSTCVSHI | 1.000 | 1630 |
| 37 | NACLSHMFFI | 1.000 | 1631 |
| 17 | ISTLVTMLSI | 1.000 | 1632 |
| 205 | RFGKQAPAYV | 1.000 | 1633 |

TABLE XIV-continued

V1-A24-10mers: 238P1B2

| Pos | 1234567890 | Score | SEQ ID |
|---|---|---|---|
| 47 | KFFTVMESSV | 1.000 | 1634 |
| 28 | WFNVREISFN | 0.750 | 1635 |
| 26 | IFWFNVREIS | 0.700 | 1636 |
| 220 | NTYLLISPLM | 0.700 | 1637 |
| 61 | AFDRFVAVSN | 0.700 | 1638 |
| 179 | TFSTCVSHIV | 0.700 | 1639 |
| 63 | DRFVAVSNPL | 0.672 | 1640 |
| 11 | TDLGLSISTL | 0.600 | 1641 |
| 67 | AVSNPLRYAM | 0.600 | 1642 |
| 233 | IYSVKTKQIR | 0.600 | 1643 |
| 31 | VREISFNACL | 0.600 | 1644 |
| 14 | GLSISTLVTM | 0.500 | 1645 |
| 88 | VASVIRGLLM | 0.500 | 1646 |
| 118 | HSYCYHPDVM | 0.500 | 1647 |
| 119 | SYCYHPDVMK | 0.500 | 1648 |
| 34 | ISFNACLSHM | 0.500 | 1649 |
| 109 | SYCHSQVLHH | 0.500 | 1650 |
| 136 | INSAVGLTAM | 0.500 | 1651 |
| 135 | RINSAVGLTA | 0.420 | 1652 |
| 214 | VHTMIANTYL | 0.400 | 1653 |
| 93 | RGLLMLTPMV | 0.360 | 1654 |
| 21 | VTMLSIFWFN | 0.252 | 1655 |
| 223 | LLISPLMNPV | 0.216 | 1656 |
| 190 | FAIYYIPLIS | 0.210 | 1657 |
| 162 | LIIRTVLSVA | 0.210 | 1658 |
| 29 | FNVREISFNA | 0.210 | 1659 |

TABLE XIV

V1B-A24-10mers: 238P1B2

| Pos | 1234567890 | Score | SEQ ID |
|---|---|---|---|
| 15 | IFLLTGVPGL | 30.000 | 1660 |
| 50 | LFATITQPSL | 20.000 | 1661 |
| 26 | AFHTWISTPF | 14.000 | 1662 |
| 29 | TWISIPFCFL | 7.200 | 1663 |
| 41 | TALLGNSLIL | 6.000 | 1664 |
| 61 | EPMYYFLSML | 6.000 | 1665 |

TABLE XIV-continued

V1B-A24-10mers: 238P1B2

| Pos | 1234567890 | Score | SEQ ID |
|---|---|---|---|
| 39 | SVTALLGNSL | 5.760 | 1666 |
| 35 | FCFLSVTALL | 5.600 | 1667 |
| 9 | ITSTSIIFLL | 5.600 | 1668 |
| 58 | SLHEPMYYFL | 4.800 | 1669 |
| 8 | NITSTSIIFL | 4.000 | 1670 |
| 7 | QNITSTSIIF | 3.000 | 1671 |
| 42 | ALLGNSLILF | 3.000 | 1672 |
| 28 | HTWISIPFCF | 2.800 | 1673 |
| 34 | PFCFLSVTAL | 2.000 | 1674 |
| 18 | LTGVPGLEAF | 2.000 | 1675 |
| 5 | TLQNITSTSI | 1.500 | 1676 |
| 6 | LQNITSTSII | 1.500 | 1677 |
| 45 | GNSLILFATT | 1.440 | 1678 |
| 54 | ITQPSLHEPM | 1.080 | 1679 |
| 40 | VTALLGNSLI | 1.000 | 1680 |
| 57 | PSLHEPMYYF | 0.300 | 1681 |
| 31 | ISIPFCFLSV | 0.216 | 1682 |
| 4 | STLQNITSTS | 0.210 | 1683 |
| 44 | LGNSLILFAT | 0.210 | 1684 |
| 22 | PGLEAFHTWI | 0.180 | 1685 |
| 12 | TSIIFLLTGV | 0.180 | 1686 |
| 38 | LSVTALLGNS | 0.180 | 1687 |
| 10 | TSTSIIFLLT | 0.168 | 1688 |
| 49 | ILFATITQPS | 0.168 | 1689 |
| 20 | GVPGLEAFHT | 0.150 | 1690 |
| 32 | SIPFCFLSVT | 0.150 | 1691 |
| 46 | NSLILFATIT | 0.150 | 1692 |
| 23 | GLEAFHTWIS | 0.150 | 1693 |
| 55 | TQPSLHEPMY | 0.150 | 1694 |
| 1 | FITSTLQNIT | 0.144 | 1695 |
| 43 | LLGNSLILFA | 0.120 | 1696 |
| 33 | IPFCFLSVTA | 0.120 | 1697 |
| 21 | VPGLEAFHTW | 0.120 | 1698 |
| 17 | LLTGVPGLEA | 0.110 | 1699 |
| 3 | TSTLQNITST | 0.100 | 1700 |
| 56 | QPSLHEPMYY | 0.100 | 1701 |
| 24 | LEAFHTWISI | 0.100 | 1702 |

TABLE XIV-continued

V1B-A24-10mers: 238P1B2

| Pos | 1234567890 | Score | SEQ ID |
|---|---|---|---|
| 30 | WISIPFCFLS | 0.100 | 1703 |
| 37 | FLSVTALLGN | 0.100 | 1704 |
| 2 | ITSTLQNITS | 0.100 | 1705 |
| 60 | HEPMYYFLSM | 0.090 | 1706 |
| 36 | CFLSVTALLG | 0.075 | 1707 |
| 19 | TGVPGLEAFH | 0.022 | 1708 |
| 16 | FLLTGVPGLE | 0.021 | 1709 |
| 59 | LHEPMYYFLS | 0.018 | 1710 |
| 13 | SIIFLLTGVP | 0.018 | 1711 |
| 48 | LILFATITQP | 0.015 | 1712 |
| 52 | ATITQPSLHE | 0.015 | 1713 |
| 47 | SLILFATITQ | 0.015 | 1714 |
| 62 | PMYYFLSMLS | 0.012 | 1715 |
| 53 | TITQPSLHEP | 0.011 | 1716 |
| 14 | IIFLLTGVPG | 0.010 | 1717 |
| 27 | FHTWISIPFC | 0.010 | 1718 |
| 11 | STSIIFLLTG | 0.010 | 1719 |
| 25 | EAFHTWISIP | 0.010 | 1720 |
| 51 | FATITQPSLH | 0.010 | 1721 |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |

TABLE XIV

V2-A24-10mers

| Pos | 1234567890 | Score | SEQ ID |
|---|---|---|---|
| 6 | TYLLTSPLMN | 7.500 | 1722 |
| 4 | ANTYLLTSPL | 4.800 | 1723 |
| 9 | LTSPLMNPVI | 1.200 | 1724 |
| 5 | NTYLLTSPLM | 0.500 | 1725 |
| 1 | TMIANTYLLT | 0.150 | 1726 |
| 10 | TSPLMNPVIY | 0.150 | 1727 |
| 8 | LLTSPLMNPV | 0.144 | 1728 |
| 2 | MIANTYLLTS | 0.100 | 1729 |
| 3 | IANTYLLTSP | 0.018 | 1730 |
| 7 | YLLTSPLMNP | 0.015 | 1731 |

TABLE XV

V1-B7-9-mers: 238P1B2

| Pos | 123456789 | Score | SEQ ID |
|---|---|---|---|
| 70 | NPLRYAMIL | 80.000 | 1732 |
| 50 | TVMESSVLL | 60.000 | 1733 |
| 160 | YVLIIRTVL | 30.000 | 1734 |
| 210 | APAYVHTMI | 24.000 | 1735 |
| 90 | SVIRGLLML | 20.000 | 1736 |
| 87 | GVASVIRGL | 20.000 | 1737 |
| 88 | VASVIRGLL | 18.000 | 1738 |
| 215 | HTMIANTYL | 12.000 | 1739 |
| 5 | LSMLSATDL | 12.000 | 1740 |
| 150 | GVDLLLILL | 6.000 | 1741 |
| 96 | LMLTPMVAL | 6.000 | 1742 |
| 30 | NVREISFNA | 5.000 | 1743 |
| 108 | LSYCHSQVL | 4.000 | 1744 |
| 16 | SISTLVTML | 4.000 | 1745 |
| 154 | LLILLSYVL | 4.000 | 1746 |
| 241 | IRRAVIKIL | 4.000 | 1747 |
| 146 | FSTVGVDLL | 4.000 | 1748 |
| 149 | VGVDLLLIL | 4.000 | 1749 |
| 240 | QIRRAVIKI | 4.000 | 1750 |
| 216 | TMIANTYLL | 4.000 | 1751 |
| 220 | NTYLLISPL | 4.000 | 1752 |
| 49 | FTVMESSVL | 4.000 | 1753 |
| 195 | IPLISLSIV | 4.000 | 1754 |
| 7 | MLSATDLGL | 4.000 | 1755 |
| 147 | STVGVDLLL | 4.000 | 1756 |
| 12 | DLGLSISTL | 4.000 | 1757 |
| 97 | MLTPMVALL | 4.000 | 1758 |
| 89 | ASVIRGLLM | 3.000 | 1759 |
| 209 | QAPAYVHTM | 3.000 | 1760 |
| 67 | AVSNPLRYA | 2.250 | 1761 |
| 148 | TVGVDLLLI | 2.000 | 1762 |
| 80 | DSRIAQIGV | 2.000 | 1763 |
| 230 | NPVIYSVKT | 2.000 | 1764 |
| 187 | IVAFAIYYI | 2.000 | 1765 |
| 58 | LAMAFDRFV | 1.800 | 1766 |
| 143 | TAMFSTVGV | 1.800 | 1767 |
| 68 | VSNPLRYAM | 1.500 | 1768 |
| 189 | AFAIYYIPL | 1.200 | 1769 |
| 9 | SATDLGLSI | 1.200 | 1770 |
| 75 | AMILTDSRI | 1.200 | 1771 |
| 190 | FAIYYIPLI | 1.200 | 1772 |
| 38 | ACLSHMFFI | 1.200 | 1773 |
| 84 | AQIGVASVI | 1.200 | 1774 |
| 93 | RGLLMLTPM | 1.000 | 1775 |
| 163 | IIRTVLSVA | 1.000 | 1776 |
| 91 | VIRGLLMLT | 1.000 | 1777 |
| 15 | LSISTLVTM | 1.000 | 1778 |
| 137 | NSAVGLTAM | 1.000 | 1779 |
| 60 | MAFDRFVAV | 0.600 | 1780 |
| 123 | HPDVMKLSC | 0.600 | 1781 |
| 99 | TPMVALLIR | 0.600 | 1782 |
| 83 | IAQIGVASV | 0.600 | 1783 |
| 192 | IYYIPLISL | 0.600 | 1784 |
| 213 | YVHTMIANT | 0.500 | 1785 |
| 202 | IVHRFGKQA | 0.500 | 1786 |
| 183 | CVSHIVAFA | 0.500 | 1787 |
| 171 | ASPEERKET | 0.450 | 1788 |
| 59 | AMAFDRFVA | 0.450 | 1789 |
| 64 | RFVAVSNPL | 0.400 | 1790 |
| 69 | SNPLRYAMI | 0.400 | 1791 |
| 98 | LTPMVALLI | 0.400 | 1792 |
| 121 | CYHPDVMKL | 0.400 | 1793 |
| 32 | REISFNACL | 0.400 | 1794 |
| 18 | STLVTMLSI | 0.400 | 1795 |
| 217 | MIANTYLLI | 0.400 | 1796 |
| 145 | MFSTVGVDL | 0.400 | 1797 |
| 100 | PMVALLIRL | 0.400 | 1798 |
| 128 | KLSCTDTRI | 0.400 | 1799 |
| 184 | VSHIVAFAI | 0.400 | 1800 |
| 194 | YIPLISLSI | 0.400 | 1801 |
| 155 | LILLSYVLI | 0.400 | 1802 |
| 134 | TRINSAVGL | 0.400 | 1803 |
| 225 | ISPLMNPVI | 0.400 | 1804 |
| 156 | ILLSYVLII | 0.400 | 1805 |

TABLE XV-continued

V1-B7-9mers: 238P1B2

| Pos | 123456789 | Score | SEQ ID |
|---|---|---|---|
| 226 | SPLMNPVIY | 0.400 | 1806 |
| 237 | KTKQIRRAV | 0.300 | 1807 |
| 103 | ALLIRLSYC | 0.300 | 1808 |
| 139 | AVGLTAMFS | 0.300 | 1809 |
| 95 | LLMLTPMVA | 0.300 | 1810 |
| 13 | LGLSISTLV | 0.200 | 1811 |
| 105 | LIRLSYCHS | 0.200 | 1812 |
| 23 | MLSIFWFNV | 0.200 | 1813 |
| 162 | LIIRTVLSV | 0.200 | 1814 |
| 153 | LLLILLSYV | 0.200 | 1815 |
| 206 | FGKQAPAYV | 0.200 | 1816 |
| 94 | GLLMLTPMV | 0.200 | 1817 |
| 180 | FSTCVSHIV | 0.200 | 1818 |
| 107 | RLSYCHSQV | 0.200 | 1819 |
| 228 | LMNPVIYSV | 0.200 | 1820 |
| 141 | GLTAMFSTV | 0.200 | 1821 |
| 224 | LISPLMNPV | 0.200 | 1822 |
| 118 | HSYCYHPDV | 0.200 | 1823 |
| 125 | DVMKLSCTD | 0.150 | 1824 |
| 244 | AVIKILHSK | 0.150 | 1825 |
| 172 | SPEERKETF | 0.120 | 1826 |
| 78 | LTDSRIAQI | 0.120 | 1827 |
| 52 | MESSVLLAM | 0.100 | 1828 |
| 14 | GLSISTLVT | 0.100 | 1829 |
| 158 | LSYVLIIRT | 0.100 | 1830 |
| 119 | SYCYHPDVM | 0.100 | 1831 |

TABLE XV

V1B-B7-9mers: 238P1B2

| Pos | 123456789 | Score | SEQ ID |
|---|---|---|---|
| 61 | EPMYYFLSM | 60.000 | 1832 |
| 51 | FATITQPSL | 12.000 | 1833 |
| 42 | ALLGNSLIL | 12.000 | 1834 |
| 30 | WISIPFCFL | 6.000 | 1835 |
| 16 | FLLTGVPGL | 4.000 | 1836 |
| 10 | TSTSIIFLL | 4.000 | 1837 |

TABLE XV-continued

V1B-B7-9mers: 238P1B2

| Pos | 123456789 | Score | SEQ ID |
|---|---|---|---|
| 40 | VTALLGNSL | 4.000 | 1838 |
| 35 | FCFLSVTAL | 4.000 | 1839 |
| 9 | ITSTSIIFL | 4.000 | 1840 |
| 21 | VPGLEAFHT | 2.000 | 1841 |
| 33 | IPFCFLSVT | 2.000 | 1842 |
| 25 | EAFHTWISI | 1.200 | 1843 |
| 41 | TALLGNSLI | 1.200 | 1844 |
| 55 | TQPSLHEPM | 1.000 | 1845 |
| 36 | CFLSVTALL | 0.400 | 1846 |
| 7 | QNITSTSII | 0.400 | 1847 |
| 1 | FITSTLQNI | 0.400 | 1848 |
| 46 | NSLILFATI | 0.400 | 1849 |
| 56 | QPSLHEPMY | 0.400 | 1850 |
| 6 | LQNITSTSI | 0.400 | 1851 |
| 62 | PMYYFLSML | 0.400 | 1852 |
| 13 | SIIFLLTGV | 0.200 | 1853 |
| 32 | SIPFCFLSV | 0.200 | 1854 |
| 18 | LTGVPGLEA | 0.150 | 1855 |
| 59 | LHEPMYYFL | 0.120 | 1856 |
| 23 | GLEAFHTWI | 0.120 | 1857 |
| 45 | GNSLILFAT | 0.100 | 1858 |
| 47 | SLILFATIT | 0.100 | 1859 |
| 44 | LGNSLILFA | 0.100 | 1860 |
| 4 | STLQNITST | 0.100 | 1861 |
| 11 | STSIIFLLT | 0.100 | 1862 |
| 2 | ITSTLQNIT | 0.100 | 1863 |
| 39 | SVTALLGNS | 0.100 | 1864 |
| 28 | HTWISIPFC | 0.100 | 1865 |
| 20 | GVPGLEAFH | 0.050 | 1866 |
| 58 | SLHEPMYYF | 0.030 | 1867 |
| 52 | ATITQPSLH | 0.030 | 1868 |
| 38 | LSVTALLGN | 0.020 | 1869 |
| 5 | TLQNITSTS | 0.020 | 1870 |
| 43 | LLGNSLILF | 0.020 | 1871 |
| 31 | ISIPFCFLS | 0.020 | 1872 |
| 19 | TGVPGLEAF | 0.020 | 1873 |
| 3 | TSTLQNITS | 0.020 | 1874 |

TABLE XV-continued

V1B-B7-9mers: 238P1B2

| Pos | 123456789 | Score | SEQ ID |
|---|---|---|---|
| 8 | NITSTSIIF | 0.020 | 1875 |
| 53 | TITQPSLHE | 0.015 | 1876 |
| 54 | ITQPSLHEP | 0.010 | 1877 |
| 14 | IIFLLTGVP | 0.010 | 1878 |
| 37 | FLSVTALLG | 0.010 | 1879 |
| 49 | TLFATITQP | 0.010 | 1880 |
| 48 | LILFATITQ | 0.010 | 1881 |
| 12 | TSIIFLLTG | 0.010 | 1882 |
| 17 | LLTGVPGLE | 0.010 | 1883 |
| 26 | AFHTWISIP | 0.003 | 1884 |
| 29 | TWISIPFCF | 0.002 | 1885 |
| 50 | LFATITQPS | 0.002 | 1886 |
| 27 | FHTWISIPF | 0.002 | 1887 |
| 22 | PGLEAFHTW | 0.002 | 1888 |
| 24 | LEAFHTWIS | 0.002 | 1889 |
| 60 | HEPMYYFLS | 0.002 | 1890 |
| 57 | PSLHEPMYY | 0.002 | 1891 |
| 15 | IFLLTGVPG | 0.001 | 1892 |
| 34 | PFCFLSVTA | 0.001 | 1893 |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XV-continued

V1B-B7-9mers: 238P1B2

| Pos | 123456789 | Score | SEQ ID |
|---|---|---|---|
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XV

V2-B7-9mers-238P1B2

| Pos | 123456789 | Score | SEQ ID |
|---|---|---|---|
| 4 | NTYLLTSPL | 4.000 | 1894 |
| 9 | TSPLMNPVI | 0.400 | 1895 |
| 8 | LTSPLMNPV | 0.200 | 1896 |
| 5 | TYLLTSPLM | 0.100 | 1897 |
| 1 | MIANTYLLT | 0.100 | 1898 |
| 2 | IANTYLLTS | 0.060 | 1899 |
| 3 | ANTYLLTSP | 0.030 | 1900 |
| 6 | YLLTSPLMN | 0.020 | 1901 |
| 7 | LLTSPLMNP | 0.015 | 1902 |

TABLE XVI

V1-B7-10-mers: 238P182

| Pos | 1234567890 | Score | SEQ ID |
|---|---|---|---|
| 99 | TPMVALLIRL | 240.000 | 1903 |
| 133 | DTRINSAVGL | 40.000 | 1904 |
| 240 | QIRRAVIKIL | 40.000 | 1905 |
| 87 | GVASVIRGLL | 30.000 | 1906 |
| 67 | AVSNPLRYAM | 22.500 | 1907 |
| 148 | TVGVDLLLIL | 20.000 | 1908 |
| 191 | AIYYIPLISL | 18.000 | 1909 |
| 95 | LLMLTPMVAL | 18.000 | 1910 |
| 219 | ANTYLLISPL | 12.000 | 1911 |
| 144 | AMFSTVGVDL | 12.000 | 1912 |
| 89 | ASVIRGLLML | 12.000 | 1913 |
| 215 | HTMIANTYLL | 12.000 | 1914 |
| 188 | VAFAIYYIPL | 12.000 | 1915 |
| 210 | APAYVHTMIA | 6.000 | 1916 |
| 30 | NVREISFNAC | 5.000 | 1917 |
| 86 | IGVASVIRGL | 4.000 | 1918 |
| 107 | RLSYCHSQVL | 4.000 | 1919 |
| 149 | VGVDLLLILL | 4.000 | 1920 |
| 146 | FSTVGVDLLL | 4.000 | 1921 |
| 69 | SNPLRYAMIL | 4.000 | 1922 |
| 96 | LMLTPMVALL | 4.000 | 1923 |
| 49 | FTVMESSVLL | 4.000 | 1924 |
| 6 | SMLSATDLGL | 4.000 | 1925 |
| 4 | FLSMLSATDL | 4.000 | 1926 |
| 120 | YCYHPDVMKL | 4.000 | 1927 |
| 15 | LSISTLVTML | 4.000 | 1928 |
| 153 | LLLILLSYVL | 4.000 | 1929 |
| 74 | YAMILTDSRI | 3.600 | 1930 |
| 88 | VASVIRGLLM | 3.000 | 1931 |
| 183 | CVSHIVAFAI | 2.000 | 1932 |
| 70 | NPLRYAMILT | 2.000 | 1933 |
| 139 | AVGLTAMFST | 1.500 | 1934 |
| 125 | DVMKLSCTDT | 1.500 | 1935 |
| 50 | TVMESSVLLA | 1.500 | 1936 |
| 58 | LAMAFDRFVA | 1.350 | 1937 |
| 209 | QAPAYVHTMI | 1.200 | 1938 |
| 37 | NACLSHMFFI | 1.200 | 1939 |
| 83 | IAQIGVASVI | 1.200 | 1940 |
| 80 | DSRIAQIGVA | 1.000 | 1941 |
| 220 | NTYLLISPLM | 1.000 | 1942 |
| 34 | ISFNACLSHM | 1.000 | 1943 |
| 118 | HSYCYHPDVM | 1.000 | 1944 |
| 136 | INSAVGLTAM | 1.000 | 1945 |
| 208 | KQAPAYVHTM | 1.000 | 1946 |
| 14 | GLSISTLVTM | 1.000 | 1947 |
| 59 | AMAFDRFVAV | 0.600 | 1948 |
| 237 | KTKQIRRAVI | 0.600 | 1949 |
| 226 | SPLMNPVIYS | 0.600 | 1950 |
| 123 | HPDVMKLSCT | 0.600 | 1951 |
| 159 | SYVLIIRTVL | 0.600 | 1952 |
| 90 | SVIRGLLMLT | 0.500 | 1953 |
| 235 | SVKTKQIRRA | 0.500 | 1954 |
| 66 | VAVSNPLRYA | 0.450 | 1955 |
| 170 | VASPEERKET | 0.450 | 1956 |
| 224 | LISPLMNPVI | 0.400 | 1957 |
| 48 | FFTVMESSVL | 0.400 | 1958 |
| 214 | VHTMIANTYL | 0.400 | 1959 |
| 154 | LLILLSYVLI | 0.400 | 1960 |
| 25 | SIFWFNVREI | 0.400 | 1961 |
| 8 | LSATDLGLSI | 0.400 | 1962 |
| 232 | VIYSVKTKQI | 0.400 | 1963 |
| 11 | TDLGLSISTL | 0.400 | 1964 |
| 97 | MLTPMVALLI | 0.400 | 1965 |
| 17 | ISTLVTMLSI | 0.400 | 1966 |
| 186 | HIVAFAIYYI | 0.400 | 1967 |
| 239 | KQIRRAVIKI | 0.400 | 1968 |
| 216 | TMIANTYLLI | 0.400 | 1969 |
| 145 | MFSTVGVDLL | 0.400 | 1970 |
| 68 | VSNPLRYAMI | 0.400 | 1971 |
| 77 | ILTDSRIAQI | 0.400 | 1972 |
| 147 | STVGVDLLLI | 0.400 | 1973 |
| 63 | DRFVAVSNPL | 0.400 | 1974 |
| 155 | LILLSYVLII | 0.400 | 1975 |
| 178 | ETFSTCVSHI | 0.400 | 1976 |

TABLE XVI-continued

V1-B7-10-mers: 238P1B2

| Pos | 1234567890 | Score | SEQ ID |
|---|---|---|---|
| 75 | AMILTDSRIA | 0.300 | 1977 |
| 51 | VMESSVLLAM | 0.300 | 1978 |
| 102 | VALLIRLSYC | 0.300 | 1979 |
| 223 | LLISPLMNPV | 0.200 | 1980 |
| 195 | IPLISLSIVH | 0.200 | 1981 |
| 161 | VLIIRTVLSV | 0.200 | 1982 |
| 142 | LTAMFSTVGV | 0.200 | 1983 |
| 194 | YIPLISLSIV | 0.200 | 1984 |
| 230 | NPVIYSVKTK | 0.200 | 1985 |
| 93 | RGLLMLTPMV | 0.200 | 1986 |
| 57 | LLAMAFDRFV | 0.200 | 1987 |
| 152 | DLLLILLSYV | 0.200 | 1988 |
| 140 | VGLTAMFSTV | 0.200 | 1989 |
| 158 | LSYVLIIRTV | 0.200 | 1990 |
| 42 | HMFFIKFFTV | 0.200 | 1991 |
| 82 | RIAQIGVASV | 0.200 | 1992 |
| 163 | IIRTVLSVAS | 0.200 | 1993 |
| 22 | TMLSIFWFNV | 0.200 | 1994 |
| 12 | DLGLSISTLV | 0.200 | 1995 |
| 101 | MVALLIRLSY | 0.150 | 1996 |
| 244 | AVIKILHSKE | 0.150 | 1997 |
| 172 | SPEERKETFS | 0.120 | 1998 |
| 189 | AFAIYYIPLI | 0.120 | 1999 |
| 31 | VREISFNACL | 0.120 | 2000 |
| 92 | IRGLLMLTPM | 0.100 | 2001 |
| 160 | YVLIIRTVLS | 0.100 | 2002 |

TABLE XVI

V1B-B7-10mers: 238P1B2

| Pos | 1234567890 | Score | SEQ ID |
|---|---|---|---|
| 61 | EPMYYFLSML | 240.000 | 2003 |
| 39 | SVTALLGNSL | 20.000 | 2004 |
| 41 | TALLGNSLIL | 12.000 | 2005 |
| 35 | FCFLSVTALL | 4.000 | 2006 |
| 58 | SLHEPMYYFL | 4.000 | 2007 |
| 9 | ITSTSIIFLL | 4.000 | 2008 |

TABLE XVI-continued

V1B-B7-10mers: 238P1B2

| Pos | 1234567890 | Score | SEQ ID |
|---|---|---|---|
| 8 | NITSTSIIFL | 4.000 | 2009 |
| 33 | IPFCFLSVTA | 2.000 | 2010 |
| 54 | ITQPSLHEPM | 1.000 | 2011 |
| 29 | TWISIPFCFL | 0.600 | 2012 |
| 20 | GVPGLEAFHT | 0.500 | 2013 |
| 50 | LFATITQPSL | 0.400 | 2014 |
| 56 | QPSLHEPMYY | 0.400 | 2015 |
| 40 | VTALLGNSLI | 0.400 | 2016 |
| 6 | LQNITSTSII | 0.400 | 2017 |
| 45 | GNSLILFATI | 0.400 | 2018 |
| 15 | IFLLTGVPGL | 0.400 | 2019 |
| 5 | TLQNITSTSI | 0.400 | 2020 |
| 21 | VPGLEAFHTW | 0.400 | 2021 |
| 31 | ISIPFCFLSV | 0.200 | 2022 |
| 12 | TSIIFLLTGV | 0.200 | 2023 |
| 17 | LLTGVPGLEA | 0.150 | 2024 |
| 44 | LGNSLILFAT | 0.100 | 2025 |
| 32 | SIPFCFLSVT | 0.100 | 2026 |
| 10 | TSTSIIFLLT | 0.100 | 2027 |
| 3 | TSTLQNITST | 0.100 | 2028 |
| 43 | LLGNSLILFA | 0.100 | 2029 |
| 60 | HEPMYYFLSM | 0.100 | 2030 |
| 46 | NSLILFATIT | 0.100 | 2031 |
| 1 | FITSTLQNIT | 0.100 | 2032 |
| 42 | ALLGNSLILF | 0.060 | 2033 |
| 52 | ATITQPSLHE | 0.045 | 2034 |
| 34 | PFCFLSVTAL | 0.040 | 2035 |
| 22 | PGLEAFHTWI | 0.040 | 2036 |
| 24 | LEAFHTWISI | 0.040 | 2037 |
| 51 | FATITQPSLH | 0.030 | 2038 |
| 25 | EAFHTWISIP | 0.030 | 2039 |
| 18 | LTGVPGLEAF | 0.020 | 2040 |
| 30 | WISIPFCFLS | 0.020 | 2041 |
| 37 | FLSVTALLGN | 0.020 | 2042 |
| 38 | LSVTALLGNS | 0.020 | 2043 |
| 49 | ILFATITQPS | 0.020 | 2044 |
| 4 | STLQNITSTS | 0.020 | 2045 |

TABLE XVI-continued

V1B-B7-10mers: 238P1B2

| Pos | 1234567890 | Score | SEQ ID |
|---|---|---|---|
| 28 | HTWISIPFCF | 0.020 | 2046 |
| 7 | QNITSTSIIF | 0.020 | 2047 |
| 2 | ITSTLQNITS | 0.020 | 2048 |
| 55 | TQPSLHEPMY | 0.020 | 2049 |
| 19 | TGVPGLEAFH | 0.010 | 2050 |
| 48 | LILFATITQP | 0.010 | 2051 |
| 53 | TITQPSLHEP | 0.010 | 2052 |
| 14 | IIFLLTGVPG | 0.010 | 2053 |
| 13 | SIIFLLTGVP | 0.010 | 2054 |
| 47 | SLILFATITQ | 0.010 | 2055 |
| 11 | STSIIFLLTG | 0.010 | 2056 |
| 16 | FLLTGVPGLE | 0.010 | 2057 |
| 27 | FHTWISIPFC | 0.010 | 2058 |
| 26 | AFHTWISIPF | 0.006 | 2059 |
| 23 | GLEAFHTWIS | 0.006 | 2060 |
| 57 | PSLHEPMYYF | 0.003 | 2061 |
| 62 | PMYYFLSMLS | 0.002 | 2062 |
| 36 | CFLSVTALLG | 0.001 | 2063 |
| 59 | LHEPMYYFLS | 0.001 | 2064 |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |

TABLE XVI

V2-B7-10mers: 238P1B2

| Pos | 1234567890 | Score | SEQ ID |
|---|---|---|---|
| 4 | ANTYLLTSPL | 12.000 | 2065 |
| 5 | NTYLLTSPLM | 1.000 | 2066 |
| 9 | LTSPLMNPVI | 0.400 | 2067 |
| 8 | LLTSPLMNPV | 0.200 | 2068 |
| 1 | TMIANTYLLT | 0.100 | 2069 |
| 3 | IANTYLLTSP | 0.030 | 2070 |
| 10 | TSPLMNPVIY | 0.020 | 2071 |
| 2 | MIANTYLLTS | 0.020 | 2072 |
| 7 | YLLTSPLMNP | 0.015 | 2073 |
| 6 | TYLLTSPLMN | 0.002 | 2074 |

TABLE XVII

V1-B35-9-mers: 238P1B2

| Pos | 123456789 | Score | SEQ ID |
|---|---|---|---|
| 226 | SPLMNPVIY | 40.000 | 2075 |
| 70 | NPLRYAMIL | 20.000 | 2076 |
| 172 | SPEERKETF | 12.000 | 2077 |
| 68 | VSNPLRYAM | 10.000 | 2078 |
| 89 | ASVIRGLLM | 10.000 | 2079 |
| 137 | NSAVGLTAM | 10.000 | 2080 |
| 112 | HSQVLHHSY | 10.000 | 2081 |
| 15 | LSISTLVTM | 10.000 | 2082 |
| 210 | APAYVHTMI | 8.000 | 2083 |
| 209 | QAPAYVHTM | 6.000 | 2084 |
| 102 | VALLIRLSY | 6.000 | 2085 |
| 66 | VAVSNPLRY | 6.000 | 2086 |
| 146 | FSTVGVDLL | 5.000 | 2087 |
| 5 | LSMLSATDL | 5.000 | 2088 |
| 54 | SSVLLAMAF | 5.000 | 2089 |
| 40 | LSHMFFIKF | 5.000 | 2090 |
| 108 | LSYCHSQVL | 5.000 | 2091 |
| 198 | ISLSIVHRF | 5.000 | 2092 |
| 195 | IPLISLSIV | 4.000 | 2093 |
| 93 | RGLLMLTPM | 4.000 | 2094 |
| 80 | DSRIAQIGV | 3.000 | 2095 |
| 88 | VASVIRGLL | 3.000 | 2096 |
| 37 | NACLSHMFF | 3.000 | 2097 |
| 138 | SAVGLTAMF | 3.000 | 2098 |
| 9 | SATDLGLSI | 2.400 | 2099 |
| 186 | HIVAFAIYY | 2.000 | 2100 |
| 225 | ISPLMNPVI | 2.000 | 2101 |
| 50 | TVMESSVLL | 2.000 | 2102 |
| 230 | NPVIYSVKT | 2.000 | 2103 |
| 152 | DLLLILLSY | 2.000 | 2104 |
| 114 | QVLHHSYCY | 2.000 | 2105 |
| 149 | VGVDLLLIL | 2.000 | 2106 |
| 184 | VSHIVAFAI | 2.000 | 2107 |
| 49 | FTVMESSVL | 1.500 | 2108 |
| 171 | ASPEERKET | 1.500 | 2109 |
| 60 | MAFDRFVAV | 1.200 | 2110 |
| 237 | KTKQIRRAV | 1.200 | 2111 |
| 240 | QIRRAVIKI | 1.200 | 2112 |
| 190 | FAIYYIPLI | 1.200 | 2113 |
| 118 | HSYCYHPDV | 1.000 | 2114 |
| 19 | TLVTMLSIF | 1.000 | 2115 |
| 57 | LLAMAFDRF | 1.000 | 2116 |
| 36 | FNACLSHMF | 1.000 | 2117 |
| 16 | SISTLVTML | 1.000 | 2118 |
| 216 | TMIANTYLL | 1.000 | 2119 |
| 12 | DLGLSISTL | 1.000 | 2120 |
| 182 | TCVSHIVAF | 1.000 | 2121 |
| 87 | GVASVIRGL | 1.000 | 2122 |
| 220 | NTYLLISPL | 1.000 | 2123 |
| 154 | LLILLSYVL | 1.000 | 2124 |
| 7 | MLSATDLGL | 1.000 | 2125 |
| 215 | HTMIANTYL | 1.000 | 2126 |
| 96 | LMLTPMVAL | 1.000 | 2127 |
| 97 | MLTPMVALL | 1.000 | 2128 |
| 160 | YVLIIRTVL | 1.000 | 2129 |
| 90 | SVIRGLLML | 1.000 | 2130 |
| 180 | FSTCVSHIV | 1.000 | 2131 |
| 21 | VTMLSIFWF | 1.000 | 2132 |
| 147 | STVGVDLLL | 1.000 | 2133 |
| 128 | KLSCTDTRI | 0.800 | 2134 |
| 129 | LSCTDTRIN | 0.750 | 2135 |
| 8 | LSATDLGLS | 0.750 | 2136 |
| 83 | IAQIGVASV | 0.600 | 2137 |
| 206 | FGKQAPAYV | 0.600 | 2138 |
| 243 | RAVIKILHS | 0.600 | 2139 |
| 148 | TVGVDLLLI | 0.600 | 2140 |
| 30 | NVREISFNA | 0.600 | 2141 |
| 123 | HPDVMKLSC | 0.600 | 2142 |
| 143 | TAMFSTVGV | 0.600 | 2143 |
| 58 | LAMAFDRFV | 0.600 | 2144 |
| 53 | ESSVLLAMA | 0.500 | 2145 |
| 17 | ISTLVTMLS | 0.500 | 2146 |
| 20 | LVTMLSIFW | 0.500 | 2147 |
| 158 | LSYVLIIRT | 0.500 | 2148 |

TABLE XVII-continued

V1-B35-9mers: 238P1B2

| Pos | 123456789 | Score | SEQ ID |
|---|---|---|---|
| 98 | LTPMVALLI | 0.400 | 2149 |
| 107 | RLSYCHSQV | 0.400 | 2150 |
| 217 | MIANTYLLI | 0.400 | 2151 |
| 187 | IVAFAIYYI | 0.400 | 2152 |
| 155 | LILLSYVLI | 0.400 | 2153 |
| 38 | ACLSHMFFI | 0.400 | 2154 |
| 205 | RFGKQAPAY | 0.400 | 2155 |
| 156 | ILLSYVLII | 0.400 | 2156 |
| 18 | STLVTMLSI | 0.400 | 2157 |
| 75 | AMILTDSRI | 0.400 | 2158 |
| 84 | AQIGVASVI | 0.400 | 2159 |
| 194 | YIPLISLSI | 0.400 | 2160 |
| 69 | SNPLRYAMI | 0.400 | 2161 |
| 126 | VMKLSCTDT | 0.300 | 2162 |
| 150 | GVDLLLILL | 0.300 | 2163 |
| 163 | ITRTVLSVA | 0.300 | 2164 |
| 91 | VIRGLLMLT | 0.300 | 2165 |
| 105 | LTRLSYCHS | 0.300 | 2166 |
| 241 | IRRAVIKIL | 0.300 | 2167 |
| 218 | IANTYLLIS | 0.300 | 2168 |
| 119 | SYCYHPDVM | 0.200 | 2169 |
| 228 | LMNPVIYSV | 0.200 | 2170 |
| 32 | REISFNACL | 0.200 | 2171 |
| 141 | GLTAMFSTV | 0.200 | 2172 |
| 162 | LIIRTVLSV | 0.200 | 2173 |
| 52 | MESSVLLAM | 0.200 | 2174 |

TABLE XVII

V1B-B35-9mers: 238P1B2

| Pos | 123456789 | Score | SEQ ID |
|---|---|---|---|
| 61 | EPMYYFLSM | 40.000 | 2175 |
| 56 | QPSLHEPMY | 40.000 | 2176 |
| 10 | TSTSIIFLL | 5.000 | 2177 |
| 21 | VPGLEAFHT | 3.000 | 2178 |
| 51 | FATITQPSL | 3.000 | 2179 |
| 46 | NSLILFATI | 2.000 | 2180 |

TABLE XVII-continued

V1B-B35-9mers: 238P1B2

| Pos | 123456789 | Score | SEQ ID |
|---|---|---|---|
| 58 | SLHEPMYYF | 2.000 | 2181 |
| 33 | IPFCFLSVT | 2.000 | 2182 |
| 55 | TQPSLHEPM | 2.000 | 2183 |
| 57 | PSLHEPMYY | 1.500 | 2184 |
| 41 | TALLGNSLI | 1.200 | 2185 |
| 25 | EAFHTWISI | 1.200 | 2186 |
| 30 | WISIPFCFL | 1.000 | 2187 |
| 43 | LLGNSLILF | 1.000 | 2188 |
| 16 | FLLTGVPGL | 1.000 | 2189 |
| 19 | TGVPGLEAF | 1.000 | 2190 |
| 8 | NITSTSIIF | 1.000 | 2191 |
| 35 | FCFLSVTAL | 1.000 | 2192 |
| 42 | ALLGNSLIL | 1.000 | 2193 |
| 40 | VTALLGNSL | 1.000 | 2194 |
| 9 | ITSTSIIFL | 1.000 | 2195 |
| 31 | ISIPFCFLS | 0.500 | 2196 |
| 3 | TSTLQNITS | 0.500 | 2197 |
| 38 | LSVTALLGN | 0.500 | 2198 |
| 7 | QNITSTSII | 0.400 | 2199 |
| 6 | LQNITSTSI | 0.400 | 2200 |
| 1 | FITSTLQNI | 0.400 | 2201 |
| 32 | SIPFCFLSV | 0.200 | 2202 |
| 13 | SIIFLLTGV | 0.200 | 2203 |
| 23 | GLEAFHTWI | 0.120 | 2204 |
| 44 | LGNSLILFA | 0.100 | 2205 |
| 47 | SLILFATIT | 0.100 | 2206 |
| 5 | TLQNITSTS | 0.100 | 2207 |
| 4 | STLQNITST | 0.100 | 2208 |
| 22 | PGLEAFHTW | 0.100 | 2209 |
| 11 | STSIIFLLT | 0.100 | 2210 |
| 27 | FHTWISIPF | 0.100 | 2211 |
| 39 | SVTALLGNS | 0.100 | 2212 |
| 45 | GNSLTLFAT | 0.100 | 2213 |
| 18 | LTGVPGLEA | 0.100 | 2214 |
| 28 | HTWISIPFC | 0.100 | 2215 |
| 62 | PMYYFLSML | 0.100 | 2216 |
| 29 | TWISIPFCF | 0.100 | 2217 |

TABLE XVII-continued

V1B-B35-9mers: 238P1B2

| Pos | 123456789 | Score | SEQ ID |
|---|---|---|---|
| 2 | ITSTLQNIT | 0.100 | 2218 |
| 36 | CFLSVTALL | 0.100 | 2219 |
| 12 | TSIIFLLTG | 0.050 | 2220 |
| 59 | LHEPMYYFL | 0.030 | 2221 |
| 54 | ITQPSLHEP | 0.010 | 2222 |
| 52 | ATITQPSLH | 0.010 | 2223 |
| 37 | FLSVTALLG | 0.010 | 2224 |
| 48 | LILFATITQ | 0.010 | 2225 |
| 14 | ITFLLTGVP | 0.010 | 2226 |
| 20 | GVPGLEAFH | 0.010 | 2227 |
| 49 | ILFATITQP | 0.010 | 2228 |
| 50 | LFATITQPS | 0.010 | 2229 |
| 53 | TITQPSLHE | 0.010 | 2230 |
| 17 | LLTGVPGLE | 0.010 | 2231 |
| 24 | LEAFHTWIS | 0.010 | 2232 |
| 60 | HEPMYYFLS | 0.010 | 2233 |
| 34 | PFCFLSVTA | 0.001 | 2234 |
| 15 | IFLLTGVPG | 0.001 | 2235 |
| 26 | AFHTWISIP | 0.001 | 2236 |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XVII-continued

V1B-B35-9mers: 238P1B2

| Pos | 123456789 | Score | SEQ ID |
|---|---|---|---|
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |
| 0 | 0 | 0.000 | |

TABLE XVII

V2-B35-9mers: 238P1B2

| Pos | 123456789 | Score | SEQ ID |
|---|---|---|---|
| 9 | TSPLMNPVI | 2.000 | 2237 |
| 4 | NTYLLTSPL | 1.000 | 2238 |
| 2 | IANTYLLTS | 0.300 | 2239 |
| 8 | LTSPLMNPV | 0.200 | 2240 |
| 5 | TYLLTSPLM | 0.200 | 2241 |
| 6 | YLLTSPLMN | 0.100 | 2242 |
| 1 | MIANTYLLT | 0.100 | 2243 |
| 7 | LLTSPLMNP | 0.010 | 2244 |
| 3 | ANTYLLTSP | 0.010 | 2245 |

TABLE XVIII

V1-B35-10mers: 238P1B2

| Pos | 1234567890 | Score | SEQ ID |
|---|---|---|---|
| 99 | TPMVALLIRL | 20.000 | 2246 |
| 225 | ISPLMNPVIY | 10.000 | 2247 |
| 118 | HSYCYHPDVM | 10.000 | 2248 |
| 184 | VSHIVAFAIY | 10.000 | 2249 |
| 34 | ISFNACLSHM | 10.000 | 2250 |
| 171 | ASPEERKETF | 10.000 | 2251 |
| 88 | VASVIRGLLM | 6.000 | 2252 |
| 146 | FSTVGVDLLL | 5.000 | 2253 |
| 89 | ASVIRGLLML | 5.000 | 2254 |
| 53 | ESSVLLAMAF | 5.000 | 2255 |
| 137 | NSAVGLTAMF | 5.000 | 2256 |
| 40 | LSHMFFIKFF | 5.000 | 2257 |
| 15 | LSISTLVTML | 5.000 | 2258 |
| 208 | KQAPAYVHTM | 4.000 | 2259 |
| 188 | VAFAIYYIPL | 3.000 | 2260 |
| 240 | QIRRAVIKIL | 3.000 | 2261 |
| 133 | DTRINSAVGL | 3.000 | 2262 |
| 237 | KTKQIRRAVI | 2.400 | 2263 |
| 14 | GLSISTLVTM | 2.000 | 2264 |
| 67 | AVSNPLRYAM | 2.000 | 2265 |
| 210 | APAYVHTMIA | 2.000 | 2266 |
| 107 | RLSYCHSQVL | 2.000 | 2267 |
| 213 | YVHTMIANTY | 2.000 | 2268 |
| 17 | ISTLVTMLSI | 2.000 | 2269 |
| 226 | SPLMNPVIYS | 2.000 | 2270 |
| 113 | SQVLHHSYCY | 2.000 | 2271 |
| 149 | VGVDLLLILL | 2.000 | 2272 |
| 70 | NPLRYAMILT | 2.000 | 2273 |
| 220 | NTYLLISPLM | 2.000 | 2274 |
| 8 | LSATDLGLSI | 2.000 | 2275 |
| 65 | FVAVSNPLRY | 2.000 | 2276 |
| 136 | INSAVGLTAM | 2.000 | 2277 |
| 68 | VSNPLRYAMI | 2.000 | 2278 |
| 101 | MVALLIRLSY | 2.000 | 2279 |
| 120 | YCYHPDVMKL | 1.500 | 2280 |
| 80 | DSRIAQIGVA | 1.500 | 2281 |
| 74 | YANILTDSRI | 1.200 | 2282 |
| 172 | SPEERKETFS | 1.200 | 2283 |
| 209 | QAPAYVHTMI | 1.200 | 2284 |
| 37 | NACLSHMFFI | 1.200 | 2285 |
| 83 | IAQIGVASVI | 1.200 | 2286 |
| 95 | LLMLTPMVAL | 1.000 | 2287 |
| 20 | LVTMLSIFWF | 1.000 | 2288 |
| 153 | LLLILLSYVL | 1.000 | 2289 |
| 191 | AIYYIPLISL | 1.000 | 2290 |
| 144 | AMFSTVGVDL | 1.000 | 2291 |
| 215 | HTMIANTYLL | 1.000 | 2292 |
| 56 | VLLAMAFDRF | 1.000 | 2293 |
| 49 | FTVMESSVLL | 1.000 | 2294 |
| 4 | FLSMLSATDL | 1.000 | 2295 |
| 18 | STLVTMLSIF | 1.000 | 2296 |
| 219 | ANTYLLISPL | 1.000 | 2297 |
| 87 | GVASVIRGLL | 1.000 | 2298 |
| 148 | TVGVDLLLIL | 1.000 | 2299 |
| 36 | FNACLSHMFF | 1.000 | 2300 |
| 96 | LMLTPMVALL | 1.000 | 2301 |
| 158 | LSYVLIIRTV | 1.000 | 2302 |
| 6 | SMLSATDLGL | 1.000 | 2303 |
| 69 | SNPLRYAMIL | 1.000 | 2304 |
| 86 | IGVASVIRGL | 1.000 | 2305 |
| 39 | CLSHMFFIKF | 1.000 | 2306 |
| 197 | LISLSIVHRF | 1.000 | 2307 |
| 181 | STCVSHIVAF | 1.000 | 2308 |
| 77 | ILTDSRIAQI | 0.800 | 2309 |
| 239 | KQIRRAVIKI | 0.800 | 2310 |
| 123 | HPDVMKLSCT | 0.600 | 2311 |
| 9 | SATDLGLSIS | 0.600 | 2312 |
| 60 | MAFDRFVAVS | 0.600 | 2313 |
| 51 | VMESSVLLAM | 0.600 | 2314 |
| 147 | STVGVDLLLI | 0.600 | 2315 |
| 30 | NVREISFNAC | 0.600 | 2316 |
| 129 | LSCTDTRINS | 0.500 | 2317 |
| 180 | FSTCVSHIVA | 0.500 | 2318 |
| 112 | HSQVLHHSYC | 0.500 | 2319 |

TABLE XVIII-continued

V1-B35-10mers: 238P1B2

| Pos | 1234567890 | Score | SEQ ID |
|---|---|---|---|
| 19 | TLVTMLSIFW | 0.500 | 2320 |
| 58 | LAMAFDRFVA | 0.450 | 2321 |
| 170 | VASPEERKET | 0.450 | 2322 |
| 186 | HIVAFAIYYI | 0.400 | 2323 |
| 178 | ETFSTCVSHI | 0.400 | 2324 |
| 216 | TMIANTYLLI | 0.400 | 2325 |
| 93 | RGLLMLTPMV | 0.400 | 2326 |
| 25 | SIFWFNVREI | 0.400 | 2327 |
| 154 | LLILLSYVLI | 0.400 | 2328 |
| 97 | MLTPMVALLI | 0.400 | 2329 |
| 155 | LILLSYVLII | 0.400 | 2330 |
| 82 | RIAQIGVASV | 0.400 | 2331 |
| 232 | VIYSVKTKQI | 0.400 | 2332 |
| 183 | CVSHIVAFAI | 0.400 | 2333 |
| 224 | LISPLMNPVI | 0.400 | 2334 |
| 190 | FAIYYIPLIS | 0.300 | 2335 |
| 235 | SVKTKQIRRA | 0.300 | 2336 |
| 128 | KLSCTDTRIN | 0.300 | 2337 |
| 66 | VAVSNPLRYA | 0.300 | 2338 |
| 45 | FTKFPTVMES | 0.300 | 2339 |
| 102 | VALLIRLSYC | 0.300 | 2340 |
| 163 | IIRTVLSVAS | 0.300 | 2341 |
| 245 | VIKILHSKET | 0.300 | 2342 |
| 138 | SAVGLTAMFS | 0.300 | 2343 |
| 142 | LTAMFSTVGV | 0.200 | 2344 |
| 230 | NPVIYSVKTK | 0.200 | 2345 |

TABLE XVIII

V1B-B35-10mers: 238P1B2

| Pos | 1234567890 | Score | SEQ ID |
|---|---|---|---|
| 56 | QPSLREPMYY | 60.000 | 2346 |
| 61 | EPMYYFLSML | 20.000 | 2347 |
| 21 | VPGLEAFHTW | 10.000 | 2348 |
| 41 | TALLGNSLIL | 3.000 | 2349 |
| 58 | SLHEPMYYFL | 2.000 | 2350 |
| 33 | IPFCFLSVTA | 2.000 | 2351 |

TABLE XVIII-continued

V1B-B35-10mers: 238P1B2

| Pos | 1234567890 | Score | SEQ ID |
|---|---|---|---|
| 54 | ITQPSLHEPM | 2.000 | 2352 |
| 55 | TQPSLHEPMY | 2.000 | 2353 |
| 39 | SVTALLGNSL | 1.000 | 2354 |
| 8 | NITSTSIIFL | 1.000 | 2355 |
| 28 | HTWISIPFCF | 1.000 | 2356 |
| 31 | ISIPFCFLSV | 1.000 | 2357 |
| 35 | FCFLSVTALL | 1.000 | 2358 |
| 7 | QNITSTSIIF | 1.000 | 2359 |
| 12 | TSIIFLLTGV | 1.000 | 2360 |
| 42 | ALLGNSLILF | 1.000 | 2361 |
| 9 | ITSTSIIFLL | 1.000 | 2362 |
| 18 | LTGVPGLEAF | 1.000 | 2363 |
| 57 | PSLHEPMYYF | 0.500 | 2364 |
| 3 | TSTLQNITST | 0.500 | 2365 |
| 10 | TSTSIIFLLT | 0.500 | 2366 |
| 38 | LSVTALLGNS | 0.500 | 2367 |
| 46 | NSLILFATIT | 0.500 | 2368 |
| 6 | LQNITSTSII | 0.400 | 2369 |
| 40 | VTALLGNSLI | 0.400 | 2370 |
| 45 | GNSLTLFATI | 0.400 | 2371 |
| 5 | TLQNITSTSI | 0.400 | 2372 |
| 60 | HEPMYYFLSM | 0.200 | 2373 |
| 20 | GVPGLEAFHT | 0.150 | 2374 |
| 15 | IFLLTGVPGL | 0.100 | 2375 |
| 44 | LGNSLILFAT | 0.100 | 2376 |
| 1 | FITSTLQNIT | 0.100 | 2377 |
| 32 | SIPFCFLSVT | 0.100 | 2378 |
| 37 | FLSVTALLGN | 0.100 | 2379 |
| 30 | WISIPFCFLS | 0.100 | 2380 |
| 49 | ILFATITQPS | 0.100 | 2381 |
| 4 | STLQNITSTS | 0.100 | 2382 |
| 17 | LLTGVPGLEA | 0.100 | 2383 |
| 50 | LFATITQPSL | 0.100 | 2384 |
| 43 | LLGNSLILFA | 0.100 | 2385 |
| 29 | TWISIPFCFL | 0.100 | 2386 |
| 26 | AFHTWISIPF | 0.100 | 2387 |
| 2 | ITSTLQNITS | 0.100 | 2388 |

TABLE XVIII-continued

V1B-B35-10mers: 238P1B2

| Pos | 1234567890 | Score | SEQ ID |
|---|---|---|---|
| 22 | PGLEAFHTWI | 0.080 | 2389 |
| 24 | LEAFHTWISI | 0.040 | 2390 |
| 51 | FATITQPSLH | 0.030 | 2391 |
| 25 | EAFHTWISIP | 0.030 | 2392 |
| 23 | GLEAFHTWIS | 0.030 | 2393 |
| 34 | PFCFLSVTAL | 0.010 | 2394 |
| 27 | FHTWISIPFC | 0.010 | 2395 |
| 19 | TGVPGLEAFH | 0.010 | 2396 |
| 16 | FLLTGVPGLE | 0.010 | 2397 |
| 48 | LILFATITQP | 0.010 | 2398 |
| 52 | ATITQPSLHE | 0.010 | 2399 |
| 62 | PMYYFLSMLS | 0.010 | 2400 |
| 11 | STSIIFLLTG | 0.010 | 2401 |
| 14 | IIFLLTGVPG | 0.010 | 2402 |
| 47 | SLILFATITQ | 0.010 | 2403 |
| 13 | SIIFLLTGVP | 0.010 | 2404 |
| 53 | TITQPSLHEP | 0.010 | 2405 |
| 59 | LHEPMYYFLS | 0.003 | 2406 |
| 36 | CFLSVTALLG | 0.001 | 2407 |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |

TABLE XVIII-continued

V1B-B35-10mers: 238P1B2

| Pos | 1234567890 | Score | SEQ ID |
|---|---|---|---|
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |
| 0 |  | 0.000 |  |

TABLE XVIII

V2-B35-10mers: 238P1B2

| Pos | 1234567890 | Score | SEQ ID |
|---|---|---|---|
| 10 | TSPLMNPVIY | 10.000 | 2408 |
| 5 | NTYLLTSPLM | 2.000 | 2409 |
| 4 | ANTYLLTSPL | 1.000 | 2410 |
| 9 | LTSPLMNPVI | 0.400 | 2411 |
| 8 | LLTSPLMNPV | 0.200 | 2412 |
| 1 | TMIANTYLLT | 0.100 | 2413 |
| 2 | MIANTYLLTS | 0.100 | 2414 |
| 3 | IANTYLLTSP | 0.030 | 2415 |
| 7 | YLLTSPLMNP | 0.010 | 2416 |
| 6 | TYLLTSPLMN | 0.010 | 2417 |

TABLE XIX

238P1B2: HLA Peptide Scoring Results and Position Determination Key
Variant 1A: for Nonamers, decamers, and 15-mers, search peptide used
(SEQ ID: 2418):
MYYFLSMLSA TDLGLSISTL VTMLSIFWFN VREISFNACL SHMFFIKFFT VMESSVLLAM

AFDRFVAVSN PLRYAMILTD SRIAQIGVAS VIRGLLMLTP MVALLIRLSY CHSQVLHHSY

CYHPDVMKLS CTDTRINSAV GLTAMFSTVG VDLLLILLSY VLIIRTVLSV ASPEERKETF

STCVSHIVAF AIYYIPLISL SIVHRFGPQA PAYVHTMIAN TYLLISPLMN PVIYSVKTKQ

IRRAVIKILH SKET

Variant 1B: search peptides used:
Nonamers (aa 1-70) (SEQ ID: 2419)
FITSTLQNIT STSIIFLLTG VPGLEAFHTW ISIPFCFLSV TALLGNSLIL FATITQPSLH

EPMYYFLSML

Decamers (aa 1-71) (SEQ ID: 2420)
FITSTLQNIT STSIIFLLTG VPGLEAFHTW ISIPFCFLSV TALLGNSLIL FATITQPSLH

EPMYYFLSML S 15-mers (aa 1-76) (SEQ ID: 2421)
FITSTLQNIT STSIIFLLTG VPGLEAFHTW ISIPFCFLSV TALLGNSLIL FATITQPSLH

EPMYYFLSML SATDLG

Variant 2: search peptides used:
nonamers (aa 217-233) (SEQ ID: 2422)
MIANTYLLTSPLMNPVI decamers (aa 216-234) (SEQ ID: 2423)
TMIANTYLLTSPLMNPVIY 15-mers for MHC II (aa 211-239) (SEQ ID: 2424)
PAYVHTMIANTYLLTSPLMNPVIYSVKTK Note that variant 1A is referred to as "v.1" in the Tables below; variant 1B is referred to as "v.1B" below; variant 2 is referred to as "v.2".

TABLE XIXA, PART 1

| Pos | 1 2 3 4 5 6 7 8 9 | score | SEQ ID |
|---|---|---|---|
| HLA-A*0201 9-mers v.1: 238P1B2 | | | |
| 228 | L M N P V I Y S V | 30 | 2425 |
| 153 | L L L I L L S Y V | 29 | 2426 |
| 162 | L I I R T V L S V | 29 | 2427 |
| 156 | I L L S Y V L I I | 28 | 2428 |
| 94 | G L L M L T P M V | 27 | 2429 |
| 97 | M L T P M V A L L | 27 | 2430 |
| 83 | I A Q I G V A S V | 26 | 2431 |
| 96 | L M L T P M V A L | 26 | 2432 |
| 154 | L L I L L S Y V L | 26 | 2433 |
| 12 | D L G L S I S T L | 25 | 2434 |
| 16 | S I S T L V T M L | 25 | 2435 |
| 90 | S V I R G L L M L | 25 | 2436 |
| 224 | L I S P L M N P V | 24 | 2437 |
| 216 | T M I A N T Y L L | 23 | 2438 |
| 7 | M L S A T D L G L | 22 | 2439 |
| 87 | G V A S V I R G L | 22 | 2440 |
| 141 | G L T A M F S T V | 22 | 2441 |
| 155 | L I L L S Y V L I | 22 | 2442 |
| 240 | Q I R R A V I K I | 22 | 2443 |
| 23 | M L S I F W F N V | 21 | 2444 |
| 194 | Y I P L I S L S I | 21 | 2445 |
| 75 | A M I L T D S R I | 20 | 2446 |
| 78 | L T D S R I A Q I | 20 | 2447 |
| 91 | V I R G L L M L T | 20 | 2448 |
| 100 | P M V A L L I R L | 20 | 2449 |
| 150 | G V D L L L I L L | 20 | 2450 |
| 187 | I V A F A I Y Y I | 20 | 2451 |
| 190 | F A I Y Y I P L I | 20 | 2452 |
| 192 | I Y Y I P L I S L | 20 | 2453 |
| 220 | N T Y L L I S P L | 20 | 2454 |
| 18 | S T L V T M L S I | 19 | 2455 |
| 50 | T V M E S S V L L | 19 | 2456 |
| 60 | M A F D R F V A V | 19 | 2457 |
| 107 | R L S Y C H S Q V | 19 | 2458 |
| 128 | K L S C T D T R I | 19 | 2459 |
| 143 | T A M F S T V G V | 19 | 2460 |
| 147 | S T V G V D L L L | 19 | 2461 |
| 217 | M I A N T Y L L I | 19 | 2462 |
| 223 | L L I S P L M N P | 19 | 2463 |
| 9 | S A T D L G L S I | 18 | 2464 |
| 14 | G L S I S T L V T | 18 | 2465 |
| 58 | L A M A F D R F V | 18 | 2466 |
| 103 | A L L I R L S Y C | 18 | 2467 |
| 121 | C Y H P D V M K L | 18 | 2468 |
| 149 | V G V D L L L I L | 18 | 2469 |
| 152 | D L L L I L L S Y | 18 | 2470 |
| 159 | S Y V L I I R T V | 18 | 2471 |
| 160 | Y V L I I R T V L | 18 | 2472 |

TABLE XIXA, PART 1-continued

| Pos | 1 2 3 4 5 6 7 8 9 | score | SEQ ID |
|---|---|---|---|
| 163 | I I R T V L S V A | 18 | 2473 |
| 195 | I P L I S L S I V | 18 | 2474 |
| 51 | V M E S S V L L A | 17 | 2475 |
| 95 | L L M L T P M V A | 17 | 2476 |
| 135 | R I N S A V G L T | 17 | 2477 |
| 148 | T V G V D L L L I | 17 | 2478 |
| 161 | V L I I R T V L S | 17 | 2479 |
| 4 | F L S M L S A T D | 16 | 2480 |
| 15 | L S I S T L V T M | 16 | 2481 |
| 26 | I F W F N V R E I | 16 | 2482 |
| 104 | L L I R L S Y C H | 16 | 2483 |
| 146 | F S T V G V D L L | 16 | 2484 |
| 197 | L I S L S I V H R | 16 | 2485 |
| 209 | Q A P A Y V H T M | 16 | 2486 |
| 213 | Y V H T M I A N T | 16 | 2487 |
| 32 | R E I S F N A C L | 15 | 2488 |
| 49 | F T V M E S S V L | 15 | 2489 |
| 59 | A M A F D R F V A | 15 | 2490 |
| 67 | A V S N P L R Y A | 15 | 2491 |
| 88 | V A S V I R G L L | 15 | 2492 |
| 98 | L T P M V A L L I | 15 | 2493 |
| 131 | C T D T R I N S A | 15 | 2494 |
| 134 | T R I N S A V G L | 15 | 2495 |
| 144 | A M F S T V G V D | 15 | 2496 |
| 157 | L L S Y V L I I R | 15 | 2497 |
| 189 | A F A I Y Y I P L | 15 | 2498 |
| 215 | H T M I A N T Y L | 15 | 2499 |
| 222 | Y L L I S P L M N | 15 | 2500 |
| 237 | K T K Q I R R A V | 15 | 2501 |
| 241 | I R R A V I K I L | 15 | 2502 |
| 244 | A V I K I L H S K | 15 | 2503 |
| 6 | S M L S A T D L G | 14 | 2504 |
| 13 | L G L S I S T L V | 14 | 2505 |
| 19 | T L V T M L S I F | 14 | 2506 |
| 25 | S I F W F N V R E | 14 | 2507 |
| 43 | M F F I K F F T V | 14 | 2508 |
| 57 | L L A M A F D R F | 14 | 2509 |
| 76 | M I L T D S R I A | 14 | 2510 |
| 84 | A Q I G V A S V I | 14 | 2511 |
| 167 | V L S V A S P E E | 14 | 2512 |
| 183 | C V S H I V A F A | 14 | 2513 |
| 3 | Y F L S M L S A T | 13 | 2514 |
| 5 | L S M L S A T D L | 13 | 2515 |
| 56 | V L L A M A F D R | 13 | 2516 |
| 70 | N P L R Y A M I L | 13 | 2517 |
| 77 | I L T D S R I A Q | 13 | 2518 |
| 82 | R I A Q I G V A S | 13 | 2519 |
| 108 | L S Y C H S Q V L | 13 | 2520 |
| 118 | H S Y C Y H P D V | 13 | 2521 |
| 137 | N S A V G L T A M | 13 | 2522 |
| 138 | S A V G L T A M F | 13 | 2523 |
| 218 | I A N T Y L L I S | 13 | 2524 |
| 227 | P L M N P V I Y S | 13 | 2525 |
| 10 | A T D L G L S I S | 12 | 2526 |
| 38 | A C L S H M F F I | 12 | 2527 |
| 42 | H M F F I K F F T | 12 | 2528 |
| 45 | F I K F F T V M E | 12 | 2529 |
| 48 | F F T V M E S S V | 12 | 2530 |
| 69 | S N P L R Y A M I | 12 | 2531 |
| 74 | Y A M I L T D S R | 12 | 2532 |
| 81 | S R I A Q I G V A | 12 | 2533 |
| 126 | V M K L S C T D T | 12 | 2534 |
| 145 | M F S T V G V D L | 12 | 2535 |
| 158 | L S Y V L I I R T | 12 | 2536 |
| 165 | R T V L S V A S P | 12 | 2537 |
| 179 | T F S T C V S H I | 12 | 2538 |
| 199 | S L S I V H R F G | 12 | 2539 |
| 201 | S I V H R F G K Q | 12 | 2540 |
| 206 | F G K Q A P A Y V | 12 | 2541 |
| 232 | V I Y S V K T K Q | 12 | 2542 |
| 233 | I Y S V K T K Q I | 12 | 2543 |
| 11 | T D L G L S I S T | 11 | 2544 |
| 35 | S F N A C L S H M | 11 | 2545 |
| 64 | R F V A V S N P L | 11 | 2546 |
| 68 | V S N P L R Y A M | 11 | 2547 |
| 101 | M V A L L I R L S | 11 | 2548 |
| 115 | V L H H S Y C Y H | 11 | 2549 |

TABLE XIXA, PART 1-continued

| Pos | 1 2 3 4 5 6 7 8 9 | score | SEQ ID |
|---|---|---|---|
| 180 | F S T C V S H I V | 11 | 2550 |
| 191 | A I Y Y I P L I S | 11 | 2551 |
| 193 | Y Y I P L I S L S | 11 | 2552 |
| 208 | K Q A P A Y V H T | 11 | 2553 |
| 210 | A P A Y V H T M I | 11 | 2554 |
| 225 | I S P L M N P V I | 11 | 2555 |
| 245 | V I K I L H S K E | 11 | 2556 |
| 2 | Y Y F L S M L S A | 10 | 2557 |
| 21 | V T M L S I F W F | 10 | 2558 |
| 22 | T M L S I F W F N | 10 | 2559 |
| 30 | N V R E I S F N A | 10 | 2560 |
| 39 | C L S H M F F I K | 10 | 2561 |
| 52 | M E S S V L L A M | 10 | 2562 |
| 55 | S V L L A M A F D | 10 | 2563 |
| 71 | P L R Y A M I L T | 10 | 2564 |
| 72 | L R Y A M I L T D | 10 | 2565 |
| 80 | D S R I A Q I G V | 10 | 2566 |
| 85 | Q I G V A S V I R | 10 | 2567 |
| 93 | R G L L M L T P M | 10 | 2568 |
| 102 | V A L L I R L S Y | 10 | 2569 |
| 105 | L I R L S Y C H S | 10 | 2570 |
| 132 | T D T R I N S A V | 10 | 2571 |
| 176 | R K E T F S T C V | 10 | 2572 |
| 181 | S T C V S H I V A | 10 | 2573 |
| 184 | V S H I V A F A I | 10 | 2574 |
| 196 | P L I S L S I V H | 10 | 2575 |
| 202 | I V H R F G K Q A | 10 | 2576 |
| 204 | H R F G K Q A P A | 10 | 2577 |
| 238 | T K Q I R R A V I | 10 | 2578 |
| 243 | R A V I K I L H S | 10 | 2579 |
| 61 | A F D R F V A V S | 9 | 2580 |
| 136 | I N S A V G L T A | 9 | 2581 |
| 140 | V G L T A M F S T | 9 | 2582 |
| 142 | L T A M F S T V G | 9 | 2583 |
| 151 | V D L L L I L L S | 9 | 2584 |
| 169 | S V A S P E E R K | 9 | 2585 |
| 170 | V A S P E E R K E | 9 | 2586 |
| 171 | A S P E E R K E T | 9 | 2587 |
| 186 | H I V A F A I Y Y | 9 | 2588 |
| 198 | I S L S I V H R F | 9 | 2589 |
| 230 | N P V I Y S V K T | 9 | 2590 |
| 246 | I K I L H S K E T | 9 | 2591 |
| 8 | L S A T D L G L S | 8 | 2592 |
| 44 | F F I K F F T V M | 8 | 2593 |
| 46 | I K F F T V M E S | 8 | 2594 |
| 53 | E S S V L L A M A | 8 | 2595 |
| 65 | F V A V S N P L R | 8 | 2596 |
| 106 | I R L S Y C H S Q | 8 | 2597 |
| 211 | P A Y V H T M I A | 8 | 2598 |
| 236 | V K T K Q I R R A | 8 | 2599 |
| 89 | A S V I R G L L M | 7 | 2600 |
| 110 | Y C H S Q V L H H | 7 | 2601 |
| 114 | Q V L H H S Y C Y | 7 | 2602 |
| 125 | D V M K L S C T D | 7 | 2603 |
| 182 | T C V S H I V A F | 7 | 2604 |
| 188 | V A F A I Y Y I P | 7 | 2605 |
| 219 | A N T Y L L I S P | 7 | 2606 |
| 221 | T Y L L I S P L M | 7 | 2607 |
| 231 | P V I Y S V K T K | 7 | 2608 |
| 20 | L V T M L S I F W | 6 | 2609 |
| 34 | I S F N A C L S H | 6 | 2610 |
| 41 | S H M F F I K F F | 6 | 2611 |
| 66 | V A V S N P L R Y | 6 | 2612 |
| 73 | R Y A M I L T D S | 6 | 2613 |
| 86 | I Q V A S V I R G | 6 | 2614 |
| 92 | I R G L L M L T P | 6 | 2615 |
| 99 | T P M V A L L I R | 6 | 2616 |
| 120 | Y C Y H P D V M K | 6 | 2617 |
| 124 | P D V M K L S C T | 6 | 2618 |
| 127 | M K L S C T D T R | 6 | 2619 |
| 139 | A V G L T A M F S | 6 | 2620 |
| 166 | T V L S V A S P E | 6 | 2621 |
| 178 | E T F S T C V S H | 6 | 2622 |
| 185 | S H I V A F A I Y | 6 | 2623 |
| 226 | S P L M N P V I Y | 6 | 2624 |
| 235 | S V K T K Q I R R | 6 | 2625 |
| 29 | F N V R E I S F N | 5 | 2626 |

TABLE XIXA, PART 1-continued

| Pos | 1 2 3 4 5 6 7 8 9 | score | SEQ ID |
|---|---|---|---|
| 36 | F N A C L S H M F | 5 | 2627 |
| 40 | L S H M F F I K F | 5 | 2628 |
| 111 | C H S Q V L H H S | 5 | 2629 |
| 119 | S Y C Y H P D V M | 5 | 2630 |
| 133 | D T R I N S A V G | 5 | 2631 |
| 164 | I R T V L S V A S | 5 | 2632 |
| 172 | S P E E R K E T F | 5 | 2633 |
| 174 | E E R K E T F S T | 5 | 2634 |
| 200 | L S I V H R F G K | 5 | 2635 |
| 239 | K Q I R R A V I K | 5 | 2636 |
| 24 | L S I F W F N V R | 4 | 2637 |
| 33 | E I S F N A C L S | 4 | 2638 |
| 37 | N A C L S H M F F | 4 | 2639 |
| 47 | K F F T V M E S S | 4 | 2640 |
| 54 | S S V L L A M A F | 4 | 2641 |
| 62 | F D R F V A V S N | 4 | 2642 |
| 63 | D R F V A V S N P | 4 | 2643 |
| 109 | S Y C H S Q V L H | 4 | 2644 |
| 112 | H S Q V L H H S Y | 4 | 2645 |
| 116 | L H H S Y C Y H P | 4 | 2646 |
| 129 | L S C T D T R I N | 4 | 2647 |
| 168 | L S V A S P E E R | 4 | 2648 |
| 17 | I S T L V T M L S | 3 | 2649 |
| 28 | W F N V R E I S F | 3 | 2650 |
| 123 | H P D V M K L S C | 3 | 2651 |
| 203 | V H R F G K Q A P | 3 | 2652 |
| 207 | G K Q A P A Y V H | 3 | 2653 |
| 212 | A Y V H T M I A N | 3 | 2654 |
| 214 | V H T M I A N T Y | 3 | 2655 |
| 27 | F W F N V R E I S | 2 | 2656 |
| 31 | V R E I S F N A C | 2 | 2657 |
| 113 | S Q V L H H S Y C | 2 | 2658 |
| 122 | Y H P D V M K L S | 2 | 2659 |
| 130 | S C T D T R I N S | 2 | 2660 |
| 205 | R F G K Q A P A Y | 2 | 2661 |
| 234 | Y S V K T K Q I R | 2 | 2662 |
| 242 | R R A V I K I L H | 2 | 2663 |
| 1 | M Y Y F L S M L S | 1 | 2664 |
| 177 | K E T F S T C V S | 1 | 2665 |

TABLE XIXA, PART 1-continued

| Pos | 1 2 3 4 5 6 7 8 9 | score | SEQ ID |
|---|---|---|---|
| 173 | P E E R K E T F S | -3 | 2666 |

HLA-A1 9-mers v.1: 238P1B2

| Pos | 1 2 3 4 5 6 7 8 9 | score | SEQ ID |
|---|---|---|---|
| 102 | V A L L I R L S Y | 23 | 2667 |
| 66 | V A V S N P L R Y | 22 | 2668 |
| 152 | D L L L I L L S Y | 22 | 2669 |
| 51 | V M E S S V L L A | 20 | 2670 |
| 185 | S H I V A F A I Y | 20 | 2671 |
| 10 | A T D L G L S I S | 19 | 2672 |
| 112 | H S Q V L H H S Y | 19 | 2673 |
| 147 | S T V G V D L L L | 19 | 2674 |
| 186 | H I V A F A I Y Y | 19 | 2675 |
| 205 | R F G K Q A P A Y | 17 | 2676 |
| 226 | S P L M N P V I Y | 17 | 2677 |
| 78 | L T D S R I A Q I | 16 | 2678 |
| 98 | L T P M V A L L I | 16 | 2679 |
| 123 | H P D V M K L S C | 16 | 2680 |
| 131 | C T D T R I N S A | 16 | 2681 |
| 150 | G V D L L L I L L | 16 | 2682 |
| 214 | V H T M I A N T Y | 16 | 2683 |
| 114 | Q V L H H S Y C Y | 15 | 2684 |
| 18 | S T L V T M L S I | 14 | 2685 |
| 31 | V R E I S F N A C | 14 | 2686 |
| 89 | A S V I R G L L M | 14 | 2687 |
| 40 | L S H M F F I K F | 13 | 2688 |
| 61 | A F D R F V A V S | 13 | 2689 |
| 181 | S T C V S H I V A | 13 | 2690 |
| 172 | S P E E R K E T F | 12 | 2691 |
| 90 | S V I R G L L M L | 11 | 2692 |
| 110 | Y C H S Q V L H H | 11 | 2693 |
| 34 | I S F N A C L S H | 10 | 2694 |
| 68 | V S N P L R Y A M | 10 | 2695 |
| 146 | F S T V G V D L L | 10 | 2696 |
| 173 | P E E R K E T F S | 10 | 2697 |
| 176 | R K E T F S T C V | 10 | 2698 |
| 222 | Y L L I S P L M N | 10 | 2699 |
| 9 | S A T D L G L S I | 9 | 2700 |
| 136 | I N S A V G L T A | 9 | 2701 |
| 151 | V D L L L I L L S | 9 | 2702 |

TABLE XIXA, PART 1-continued

| Pos | 1 2 3 4 5 6 7 8 9 | score | SEQ ID |
|---|---|---|---|
| 156 | I L L S Y V L I I | 9 | 2703 |
| 2 | Y Y F L S M L S A | 8 | 2704 |
| 14 | G L S I S T L V T | 8 | 2705 |
| 17 | I S T L V T M L S | 8 | 2706 |
| 24 | L S I F W F N V R | 8 | 2707 |
| 49 | F T V M E S S V L | 8 | 2708 |
| 52 | M E S S V L L A M | 8 | 2709 |
| 80 | D S R I A Q I G V | 8 | 2710 |
| 97 | M L T P M V A L L | 8 | 2711 |
| 148 | T V G V D L L L I | 8 | 2712 |
| 158 | L S Y V L I I R T | 8 | 2713 |
| 193 | Y Y I P L I S L S | 8 | 2714 |
| 194 | Y I P L I S L S I | 8 | 2715 |
| 217 | M I A N T Y L L I | 8 | 2716 |
| 7 | M L S A T D L G L | 7 | 2717 |
| 21 | V T M L S I F W F | 7 | 2718 |
| 71 | P L R Y A M I L T | 7 | 2719 |
| 121 | C Y H P D V M K L | 7 | 2720 |
| 130 | S C T D T R I N S | 7 | 2721 |
| 133 | D T R I N S A V G | 7 | 2722 |
| 142 | L T A M F S T V G | 7 | 2723 |
| 149 | V G V D L L L I L | 7 | 2724 |
| 157 | L L S Y V L I I R | 7 | 2725 |
| 162 | L I I R T V L S V | 7 | 2726 |
| 165 | R T V L S V A S P | 7 | 2727 |
| 170 | V A S P E E R K E | 7 | 2728 |
| 180 | F S T C V S H I V | 7 | 2729 |
| 184 | V S H I V A F A I | 7 | 2730 |
| 191 | A I Y Y I P L I S | 7 | 2731 |
| 201 | S I V H R F G K Q | 7 | 2732 |
| 215 | H T M I A N T Y L | 7 | 2733 |
| 218 | I A N T Y L L I S | 7 | 2734 |
| 227 | P L M N P V I Y S | 7 | 2735 |
| 237 | K T K Q I R R A V | 7 | 2736 |
| 240 | Q I R R A V I K I | 7 | 2737 |
| 8 | L S A T D L G L S | 6 | 2738 |
| 54 | S S V L L A M A F | 6 | 2739 |
| 72 | L R Y A M I L T D | 6 | 2740 |
| 77 | I L T D S R I A Q | 6 | 2741 |
| 92 | I R G L L M L T P | 6 | 2742 |
| 99 | T P M V A L L I R | 6 | 2743 |
| 122 | Y H P D V M K L S | 6 | 2744 |
| 137 | N S A V G L T A M | 6 | 2745 |
| 171 | A S P E E R K E T | 6 | 2746 |
| 178 | E T F S T C V S H | 6 | 2747 |
| 189 | A F A I Y Y I P L | 6 | 2748 |
| 196 | P L I S L S I V H | 6 | 2749 |
| 220 | N T Y L L I S P L | 6 | 2750 |
| 225 | I S P L M N P V I | 6 | 2751 |
| 228 | L M N P V I Y S V | 6 | 2752 |
| 234 | Y S V K T K Q I R | 6 | 2753 |
| 235 | S V K T K Q I R R | 6 | 2754 |
| 242 | R R A V I K I L H | 6 | 2755 |
| 243 | R A V I K I L H S | 6 | 2756 |
| 11 | T D L G L S I S T | 5 | 2757 |
| 44 | F F I K F F T V M | 5 | 2758 |
| 53 | E S S V L L A M A | 5 | 2759 |
| 81 | S R I A Q I G V A | 5 | 2760 |
| 84 | A Q I G V A S V I | 5 | 2761 |
| 86 | I G V A S V I R G | 5 | 2762 |
| 108 | L S Y C H S Q V L | 5 | 2763 |
| 118 | H S Y C Y H P D V | 5 | 2764 |
| 192 | I Y Y I P L I S L | 5 | 2765 |
| 198 | I S L S I V H R F | 5 | 2766 |
| 199 | S L S I V H R F G | 5 | 2767 |
| 200 | L S I V H R F G K | 5 | 2768 |
| 212 | A Y V H T M I A N | 5 | 2769 |
| 219 | A N T Y L L I S P | 5 | 2770 |
| 232 | V I Y S V K T K Q | 5 | 2771 |
| 5 | L S M L S A T D L | 4 | 2772 |
| 6 | S M L S A T D L G | 4 | 2773 |
| 15 | L S I S T L V T M | 4 | 2774 |
| 16 | S I S T L V T M L | 4 | 2775 |
| 20 | L V T M L S I F W | 4 | 2776 |
| 27 | F W F N V R E I S | 4 | 2777 |
| 28 | W F N V R E I S F | 4 | 2778 |
| 39 | C L S H M F F I K | 4 | 2779 |

TABLE XIXA, PART 1-continued

| Pos | 1 2 3 4 5 6 7 8 9 | score | SEQ ID |
|---|---|---|---|
| 57 | L L A M A F D R F | 4 | 2780 |
| 65 | F V A V S N P L R | 4 | 2781 |
| 88 | V A S V I R G L L | 4 | 2782 |
| 91 | V I R G L L M L T | 4 | 2783 |
| 100 | P M V A L L I R L | 4 | 2784 |
| 109 | S Y C H S Q V L H | 4 | 2785 |
| 120 | Y C Y H P D V M K | 4 | 2786 |
| 129 | L S C T D T R I N | 4 | 2787 |
| 138 | S A V G L T A M F | 4 | 2788 |
| 141 | G L T A M F S T V | 4 | 2789 |
| 160 | Y V L I I R T V L | 4 | 2790 |
| 161 | V L I I R T V L S | 4 | 2791 |
| 168 | L S V A S P E E R | 4 | 2792 |
| 190 | F A I Y Y I P L I | 4 | 2793 |
| 208 | K Q A P A Y V H T | 4 | 2794 |
| 210 | A P A Y V H T M I | 4 | 2795 |
| 224 | L I S P L M N P V | 4 | 2796 |
| 22 | T M L S I F W F N | 3 | 2797 |
| 25 | S I F W F N V R E | 3 | 2798 |
| 43 | M F F I K F F T V | 3 | 2799 |
| 59 | A M A F D R F V A | 3 | 2800 |
| 60 | M A F D R F V A V | 3 | 2801 |
| 62 | F D R F V A V S N | 3 | 2802 |
| 69 | S N P L R Y A M I | 3 | 2803 |
| 83 | I A Q I G V A S V | 3 | 2804 |
| 119 | S Y C Y H P D V M | 3 | 2805 |
| 135 | R I N S A V G L T | 3 | 2806 |
| 144 | A M F S T V G V D | 3 | 2807 |
| 145 | M F S T V G V D L | 3 | 2808 |
| 163 | I I R T V L S V A | 3 | 2809 |
| 169 | S V A S P E E R K | 3 | 2810 |
| 175 | E R K E T F S T C | 3 | 2811 |
| 203 | V H R F G K Q A P | 3 | 2812 |
| 230 | N P V I Y S V K T | 3 | 2813 |
| 236 | V K T Q I R R A | 3 | 2814 |
| 245 | V I K I L H S K E | 3 | 2815 |
| 1 | M Y Y F L S M L S | 2 | 2816 |
| 3 | Y F L S M L S A T | 2 | 2817 |
| 4 | F L S M L S A T D | 2 | 2818 |
| 13 | L G L S I S T L V | 2 | 2819 |
| 33 | E I S F N A C L S | 2 | 2820 |
| 35 | S F N A C L S H M | 2 | 2821 |
| 36 | F N A C L S H M F | 2 | 2822 |
| 41 | S H M F F I K F F | 2 | 2823 |
| 45 | F I K F F T V M E | 2 | 2824 |
| 47 | K F F T V M E S S | 2 | 2825 |
| 50 | T V M E S S V L L | 2 | 2826 |
| 55 | S V L L A M A F D | 2 | 2827 |
| 56 | V L L A M A F D R | 2 | 2828 |
| 64 | R F V A V S N P L | 2 | 2829 |
| 67 | A V S N P L R Y A | 2 | 2830 |
| 74 | Y A M I L T D S R | 2 | 2831 |
| 87 | G V A S V I R G L | 2 | 2832 |
| 94 | G L L M L T P M V | 2 | 2833 |
| 95 | L L M L T P M V A | 2 | 2834 |
| 101 | M V A L L I R L S | 2 | 2835 |
| 103 | A L L I R L S Y C | 2 | 2836 |
| 111 | C H S Q V L H H S | 2 | 2837 |
| 113 | S Q V L H H S Y C | 2 | 2838 |
| 115 | V L H H S Y C Y H | 2 | 2839 |
| 154 | L L I L L S Y V L | 2 | 2840 |
| 155 | L I L L S Y V L I | 2 | 2841 |
| 159 | S Y V L I I R T V | 2 | 2842 |
| 166 | T V L S V A S P E | 2 | 2843 |
| 167 | V L S V A S P E E | 2 | 2844 |
| 207 | G K Q A P A Y V H | 2 | 2845 |
| 209 | Q A P A Y V H T M | 2 | 2846 |
| 213 | Y V H T M I A N T | 2 | 2847 |
| 216 | T M I A N T Y L L | 2 | 2848 |
| 221 | T Y L L I S P L M | 2 | 2849 |
| 223 | L L I S P L M N P | 2 | 2850 |
| 238 | T K Q I R R A V I | 2 | 2851 |
| 241 | I R R A V I K I L | 2 | 2852 |
| 12 | D L G L S I S T L | 1 | 2853 |
| 19 | T L V T M L S I F | 1 | 2854 |
| 23 | M L S I F W F N V | 1 | 2855 |
| 26 | I F W F N V R E I | 1 | 2856 |

TABLE XIXA, PART 1-continued

| Pos | 1 2 3 4 5 6 7 8 9 | score | SEQ ID |
|---|---|---|---|
| 29 | F N V R E I S F N | 1 | 2857 |
| 32 | R E I S F N A C L | 1 | 2858 |
| 38 | A C L S H M F F I | 1 | 2859 |
| 46 | I K F F T V M E S | 1 | 2860 |
| 48 | P F T V M E S S V | 1 | 2861 |
| 63 | D R F V A V S N P | 1 | 2862 |
| 70 | N P L R Y A M I L | 1 | 2863 |
| 75 | A M I L T D S R I | 1 | 2864 |
| 82 | R I A Q I G V A S | 1 | 2865 |
| 96 | L M L T P M V A L | 1 | 2866 |
| 104 | L L I R L S Y C H | 1 | 2867 |
| 106 | I R L S Y C H S Q | 1 | 2868 |
| 107 | R L S Y C H S Q V | 1 | 2869 |
| 116 | L H S Y C Y H P | 1 | 2870 |
| 126 | V M K L S C T D T | 1 | 2871 |
| 128 | K L S C T D T R I | 1 | 2872 |
| 132 | T D T R I N S A V | 1 | 2873 |
| 139 | A V G L T A M F S | 1 | 2874 |
| 140 | V G L T A M F S T | 1 | 2875 |
| 153 | L L I L L S Y V | 1 | 2876 |
| 177 | K E T F S T C V S | 1 | 2877 |
| 179 | T F S T C V S H I | 1 | 2878 |
| 183 | C V S H I V A F A | 1 | 2879 |
| 188 | V A F A I Y Y I P | 1 | 2880 |
| 202 | I V H R F G K Q A | 1 | 2881 |
| 204 | H R F G K Q A P A | 1 | 2882 |
| 206 | F G K Q A P A Y V | 1 | 2883 |
| 229 | M N P V I Y S V K | 1 | 2884 |
| 231 | P V I Y S V K T K | 1 | 2885 |
| 244 | A V I K I L H S K | 1 | 2886 |
| HLA-A26 9-mers v.1: 238P1B2 | | | |
| 152 | D L L L I L L S Y | 29 | 2887 |
| 12 | D L G L S I S T L | 28 | 2888 |
| 21 | V T M L S I F W F | 25 | 2889 |
| 87 | G V A S V I R G L | 25 | 2890 |
| 90 | S V I R G L L M L | 25 | 2891 |
| 16 | S I S T L V T M L | 24 | 2892 |
| 57 | L L A M A F D R F | 24 | 2893 |
| 150 | G V D L L L I L L | 24 | 2894 |
| 220 | N T Y L L I S P L | 24 | 2895 |
| 19 | T L V T M L S I F | 23 | 2896 |
| 97 | M L T P M V A L L | 23 | 2897 |
| 50 | T V M E S S V L L | 22 | 2898 |
| 44 | F F I K F F T V M | 21 | 2899 |
| 178 | E T F S T C V S H | 21 | 2900 |
| 35 | S F N A C L S H M | 20 | 2901 |
| 114 | Q V L H H S Y C Y | 20 | 2902 |
| 147 | S T V G V D L L L | 20 | 2903 |
| 186 | H I V A F A I Y Y | 20 | 2904 |
| 205 | R F G K Q A P A Y | 20 | 2905 |
| 49 | F T V M E S S V L | 19 | 2906 |
| 154 | L L I L L S Y V L | 19 | 2907 |
| 189 | A F A I Y Y I P L | 19 | 2908 |
| 78 | L T D S R I A Q I | 18 | 2909 |
| 91 | V I R G L L M L T | 18 | 2910 |
| 125 | D V M K L S C T D | 18 | 2911 |
| 160 | Y V L I I R T V L | 18 | 2912 |
| 215 | H T M I A N T Y L | 18 | 2913 |
| 244 | A V I K I L H S K | 18 | 2914 |
| 7 | M L S A T D L G L | 17 | 2915 |
| 28 | W F N V R E I S F | 17 | 2916 |
| 133 | D T R I N S A V G | 17 | 2917 |
| 162 | L I I R T V L S V | 17 | 2918 |
| 165 | R T V L S V A S P | 17 | 2919 |
| 182 | T C V S H I V A F | 17 | 2920 |
| 185 | S H I V A F A I Y | 17 | 2921 |
| 197 | L I S L S I V H R | 17 | 2922 |
| 223 | L L I S P L M N P | 17 | 2923 |
| 224 | L I S P L M N P V | 17 | 2924 |
| 231 | P V I Y S V K T K | 17 | 2925 |
| 10 | A T D L G L S I S | 16 | 2926 |
| 15 | L S I S T L V T M | 16 | 2927 |
| 33 | E I S F N A C L S | 16 | 2928 |
| 101 | M V A L L I R L S | 16 | 2929 |
| 105 | L I R L S Y C H S | 16 | 2930 |
| 121 | C Y H P D V M K L | 16 | 2931 |
| 131 | C T D T R I N S A | 16 | 2932 |

TABLE XIXA, PART 1-continued

| Pos | 1 2 3 4 5 6 7 8 9 | score | SEQ ID |
|---|---|---|---|
| 155 | L I L L S Y V L I | 16 | 2933 |
| 198 | I S L S I V H R F | 16 | 2934 |
| 213 | Y V H T M I A N T | 16 | 2935 |
| 18 | S T L V T M L S I | 15 | 2936 |
| 40 | L S H M F F I K F | 15 | 2937 |
| 55 | S V L L A M A F D | 15 | 2938 |
| 135 | R I N S A V G L T | 15 | 2939 |
| 138 | S A V G L T A M F | 15 | 2940 |
| 145 | M F S T V G V D L | 15 | 2941 |
| 163 | I I R T V L S V A | 15 | 2942 |
| 183 | C V S H I V A F A | 15 | 2943 |
| 187 | I V A F A I Y Y I | 15 | 2944 |
| 201 | S I V H R F G K Q | 15 | 2945 |
| 217 | M I A N T Y L L I | 15 | 2946 |
| 240 | Q I R R A V I K I | 15 | 2947 |
| 25 | S I F W F N V R E | 14 | 2948 |
| 41 | S H M F F I K F F | 14 | 2949 |
| 52 | M E S S V L L A M | 14 | 2950 |
| 63 | D R F V A V S N P | 14 | 2951 |
| 64 | R F V A V S N P L | 14 | 2952 |
| 67 | A V S N P L R Y A | 14 | 2953 |
| 82 | R I A Q I G V A S | 14 | 2954 |
| 96 | L M L T P M V A L | 14 | 2955 |
| 100 | P M V A L L I R L | 14 | 2956 |
| 137 | N S A V G L T A M | 14 | 2957 |
| 148 | T V G V D L L L I | 14 | 2958 |
| 149 | V G V D L L L I L | 14 | 2959 |
| 153 | L L L I L L S Y V | 14 | 2960 |
| 175 | E R K E T F S T C | 14 | 2961 |
| 245 | V I K I L H S K E | 14 | 2962 |
| 3 | Y F L S M L S A T | 13 | 2963 |
| 30 | N V R E I S F N A | 13 | 2964 |
| 36 | F N A C L S H M F | 13 | 2965 |
| 43 | M F F I K F F T V | 13 | 2966 |
| 45 | F I K F F T V M E | 13 | 2967 |
| 47 | K F F T V M E S S | 13 | 2968 |
| 53 | E S S V L L A M A | 13 | 2969 |
| 54 | S S V L L A M A F | 13 | 2970 |
| 65 | F V A V S N P L R | 13 | 2971 |
| 103 | A L L I R L S Y C | 13 | 2972 |
| 115 | V L H H S Y C Y H | 13 | 2973 |
| 134 | T R I N S A V G L | 13 | 2974 |
| 141 | G L T A M F S T V | 13 | 2975 |
| 156 | I L L S Y V L I I | 13 | 2976 |
| 169 | S V A S P E E R K | 13 | 2977 |
| 192 | I Y Y I P L I S L | 13 | 2978 |
| 209 | Q A P A Y V H T M | 13 | 2979 |
| 235 | S V K T K Q I R R | 13 | 2980 |
| 237 | K T K Q I R R A V | 13 | 2981 |
| 32 | R E I S F N A C L | 12 | 2982 |
| 37 | N A C L S H M F F | 12 | 2983 |
| 39 | C L S H M F F I K | 12 | 2984 |
| 61 | A F D R F V A V S | 12 | 2985 |
| 66 | V A V S N P L R Y | 12 | 2986 |
| 68 | V S N P L R Y A M | 12 | 2987 |
| 71 | P L R Y A M I L T | 12 | 2988 |
| 93 | R G L L M L T P M | 12 | 2989 |
| 112 | H S Q V L H H S Y | 12 | 2990 |
| 146 | F S T V G V D L L | 12 | 2991 |
| 157 | L L S Y V L I I R | 12 | 2992 |
| 166 | T V L S V A S P E | 12 | 2993 |
| 172 | S P E E R K E T F | 12 | 2994 |
| 179 | T F S T C V S H I | 12 | 2995 |
| 194 | Y I P L I S L S I | 12 | 2996 |
| 196 | P L I S L S I V H | 12 | 2997 |
| 227 | P L M N P V I Y S | 12 | 2998 |
| 232 | V I Y S V K T K Q | 12 | 2999 |
| 241 | I R R A V I K I L | 12 | 3000 |
| 20 | L V T M L S I F W | 11 | 3001 |
| 26 | I F W F N V R E I | 11 | 3002 |
| 77 | I L T D S R I A Q | 11 | 3003 |
| 85 | Q I G V A S V I R | 11 | 3004 |
| 94 | G L L M L T P M V | 11 | 3005 |
| 98 | L T P M V A L L I | 11 | 3006 |
| 102 | V A L L I R L S Y | 11 | 3007 |
| 104 | L L I R L S Y C H | 11 | 3008 |
| 139 | A V G L T A M F S | 11 | 3009 |

TABLE XIXA, PART 1-continued

| Pos | 1 2 3 4 5 6 7 8 9 | score | SEQ ID |
|---|---|---|---|
| 142 | L T A M F S T V G | 11 | 3010 |
| 161 | V L I I R T V L S | 11 | 3011 |
| 181 | S T C V S H I V A | 11 | 3012 |
| 202 | I V H R F G K Q A | 11 | 3013 |
| 226 | S P L M N P V I Y | 11 | 3014 |
| 4 | F L S M L S A T D | 10 | 3015 |
| 76 | M I L T D S R I A | 10 | 3016 |
| 107 | R L S Y C H S Q V | 10 | 3017 |
| 167 | V L S V A S P E E | 10 | 3018 |
| 191 | A I Y Y I P L I S | 10 | 3019 |
| 193 | Y Y I P L I S L S | 10 | 3020 |
| 214 | V H T M I A N T Y | 10 | 3021 |
| 216 | T M I A N T Y L L | 10 | 3022 |
| 222 | Y L L I S P L M N | 10 | 3023 |
| 5 | L S M L S A T D L | 9 | 3024 |
| 14 | G L S I S T L V T | 9 | 3025 |
| 23 | M L S I F W F N V | 9 | 3026 |
| 60 | M A F D R F V A V | 9 | 3027 |
| 70 | N P L R Y A M I L | 9 | 3028 |
| 95 | L L M L T P M V A | 9 | 3029 |
| 108 | L S Y C H S Q V L | 9 | 3030 |
| 128 | K L S C T D T R I | 9 | 3031 |
| 208 | K Q A P A Y V H T | 9 | 3032 |
| 221 | T Y L L I S P L M | 9 | 3033 |
| 2 | Y Y F L S M L S A | 8 | 3034 |
| 46 | I K F F T V M E S | 8 | 3035 |
| 48 | F F T V M E S S V | 8 | 3036 |
| 56 | V L L A M A F D R | 8 | 3037 |
| 88 | V A S V I R G L L | 8 | 3038 |
| 89 | A S V I R G L L M | 8 | 3039 |
| 119 | S Y C Y H P D V M | 8 | 3040 |
| 174 | E E R K E T F S T | 8 | 3041 |
| 199 | S L S I V H R F G | 8 | 3042 |
| 69 | S N P L R Y A M I | 7 | 3043 |
| 80 | D S R I A Q I G V | 7 | 3044 |
| 81 | S R I A Q I G V A | 7 | 3045 |
| 110 | Y C H S Q V L H H | 7 | 3046 |
| 144 | A M F S T V G V D | 7 | 3047 |
| 190 | F A I Y Y I P L I | 7 | 3048 |
| 228 | L M N P V I Y S V | 7 | 3049 |
| 236 | V K T K Q I R R A | 7 | 3050 |
| 24 | L S I F W F N V R | 6 | 3051 |
| 31 | V R E I S F N A C | 6 | 3052 |
| 51 | V M E S S V L L A | 6 | 3053 |
| 83 | I A Q I G V A S V | 6 | 3054 |
| 86 | I G V A S V I R G | 6 | 3055 |
| 111 | C H S Q V L H H S | 6 | 3056 |
| 122 | Y H P D V M K L S | 6 | 3057 |
| 124 | P D V M K L S C T | 6 | 3058 |
| 158 | L S Y V L I I R T | 6 | 3059 |
| 188 | V A F A I Y Y I P | 6 | 3060 |
| 195 | I P L I S L S I V | 6 | 3061 |
| 204 | H R F G K Q A P A | 6 | 3062 |
| 219 | A N T Y L L I S P | 6 | 3063 |
| 229 | M N P V I Y S V K | 6 | 3064 |
| 243 | R A V I K I L H S | 6 | 3065 |
| 8 | L S A T D L G L S | 5 | 3066 |
| 22 | T M L S I F W F N | 5 | 3067 |
| 29 | F N V R E I S F N | 5 | 3068 |
| 38 | A C L S H M F F I | 5 | 3069 |
| 73 | R Y A M I L T D S | 5 | 3070 |
| 84 | A Q I G V A S V I | 5 | 3071 |
| 92 | I R G L L M L T P | 5 | 3072 |
| 140 | V G L T A M F S T | 5 | 3073 |
| 151 | V D L L L I L L S | 5 | 3074 |
| 212 | A Y V H T M I A N | 5 | 3075 |
| 11 | T D L G L S I S T | 4 | 3076 |
| 72 | L R Y A M I L T D | 4 | 3077 |
| 75 | A M I L T D S R I | 4 | 3078 |
| 99 | T P M V A L L I R | 4 | 3079 |
| 117 | H H S Y C Y H P D | 4 | 3080 |
| 159 | S Y V L I I R T V | 4 | 3081 |
| 171 | A S P E E R K E T | 4 | 3082 |
| 218 | I A N T Y L L I S | 4 | 3083 |
| 9 | S A T D L G L S I | 3 | 3084 |
| 34 | I S F N A C L S H | 3 | 3085 |
| 143 | T A M F S T V G V | 3 | 3086 |

TABLE XIXA, PART 1-continued

| Pos | 1 2 3 4 5 6 7 8 9 | score | SEQ ID |
|---|---|---|---|
| 164 | I R T V L S V A S | 3 | 3087 |
| 170 | V A S P E E R K E | 3 | 3088 |
| 200 | L S I V H R F G K | 3 | 3089 |
| 206 | F G K Q A P A Y V | 3 | 3090 |
| 239 | K Q I R R A V I K | 3 | 3091 |
| 246 | I K I L H S K E T | 3 | 3092 |
| 1 | M Y Y F L S M L S | 2 | 3093 |
| 27 | F W F N V R E I S | 2 | 3094 |
| 42 | H M F F I K F F T | 2 | 3095 |
| 62 | F D R F V A V S N | 2 | 3096 |
| 74 | Y A M I L T D S R | 2 | 3097 |
| 106 | I R L S Y C H S Q | 2 | 3098 |
| 109 | S Y G H S Q V L H | 2 | 3099 |
| 116 | L H H S Y C Y H P | 2 | 3100 |
| 120 | Y C Y H P D V M K | 2 | 3101 |
| 123 | H P D V M K L S C | 2 | 3102 |
| 126 | V M K L S C T D T | 2 | 3103 |
| 130 | S C T D T R I N S | 2 | 3104 |
| 132 | T D T R I N S A V | 2 | 3105 |
| 168 | L S V A S P E E R | 2 | 3106 |
| 203 | V H R F G K Q A P | 2 | 3107 |
| 210 | A P A Y V H T M I | 2 | 3108 |
| 225 | I S P L M N P V I | 2 | 3109 |
| 230 | N P V I Y S V K T | 2 | 3110 |
| 233 | I Y S V K T K Q I | 2 | 3111 |
| 234 | Y S V K T K Q I R | 2 | 3112 |
| 6 | S M L S A T D L G | 1 | 3113 |
| 13 | L G L S I S T L V | 1 | 3114 |
| 17 | I S T L V T M L S | 1 | 3115 |
| 59 | A M A F D R F V A | 1 | 3116 |
| 79 | T D S R I A Q I G | 1 | 3117 |
| 113 | S Q V L H H S Y C | 1 | 3118 |
| 118 | H S Y C Y H P D V | 1 | 3119 |
| 127 | M K L S C T D T R | 1 | 3120 |
| 173 | P E E R K E T F S | 1 | 3121 |
| 177 | K E T F S T C V S | 1 | 3122 |
| 184 | V S H I V A F A I | 1 | 3123 |
| 211 | P A Y V H T M I A | 1 | 3124 |
| 238 | T K Q I R R A V I | 1 | 3125 |
| 242 | R R A V I K I L H | 1 | 3126 |
| HLA-A3 9-mers v.1: 238P1B2 | | | |
| 239 | K Q I R R A V I K | 28 | 3127 |
| 244 | A V I K I L H S K | 28 | 3128 |
| 231 | P V I Y S V K T K | 27 | 3129 |
| 152 | D L L L I L L S Y | 24 | 3130 |
| 90 | S V I R G L L M L | 23 | 3131 |
| 169 | S V A S P E E R K | 22 | 3132 |
| 56 | V L L A M A F D R | 21 | 3133 |
| 82 | R I A Q I G V A S | 21 | 3134 |
| 103 | A L L I R L S Y C | 21 | 3135 |
| 163 | I I R T V L S V A | 21 | 3136 |
| 196 | P L I S L S I V H | 21 | 3137 |
| 202 | I V H R F G K Q A | 21 | 3138 |
| 39 | C L S H M F F I K | 20 | 3139 |
| 104 | L L I R L S Y C H | 20 | 3140 |
| 107 | R L S Y C H S Q V | 20 | 3141 |
| 114 | Q V L H H S Y C Y | 20 | 3142 |
| 161 | V L I I R T V L S | 20 | 3143 |
| 84 | A Q I G V A S V I | 19 | 3144 |
| 120 | Y C Y H P D V M K | 19 | 3145 |
| 141 | G L T A M F S T V | 19 | 3146 |
| 160 | Y V L I I R T V L | 19 | 3147 |
| 162 | L I I R T V L S V | 19 | 3148 |
| 166 | T V L S V A S P E | 19 | 3149 |
| 186 | H I V A F A I Y Y | 19 | 3150 |
| 191 | A I Y Y I P L I S | 19 | 3151 |
| 12 | D L G L S I S T L | 18 | 3152 |
| 14 | G L S I S T L V T | 18 | 3153 |
| 85 | Q I G V A S V I R | 18 | 3154 |
| 139 | A V G L T A M F S | 18 | 3155 |
| 154 | L L I L L S Y V L | 18 | 3156 |
| 222 | Y L L I S P L M N | 18 | 3157 |
| 4 | F L S M L S A T D | 17 | 3158 |
| 19 | T L V T M L S I F | 17 | 3159 |
| 55 | S V L L A M A F D | 17 | 3160 |
| 95 | L L M L T P M V A | 17 | 3161 |

TABLE XIXA, PART 1-continued

| Pos | 1 2 3 4 5 6 7 8 9 | score | SEQ ID |
|---|---|---|---|
| 156 | I L L S Y V L I I | 17 | 3162 |
| 197 | L I S L S I V H R | 17 | 3163 |
| 229 | M N P V I Y S V K | 17 | 3164 |
| 235 | S V K T K Q I R R | 17 | 3165 |
| 97 | M L T P M V A L L | 16 | 3166 |
| 153 | L L L I L L S Y V | 16 | 3167 |
| 240 | Q I R R A V I K I | 16 | 3168 |
| 7 | M L S A T D L G L | 15 | 3169 |
| 50 | T V M E S S V L L | 15 | 3170 |
| 57 | L L A M A F D R F | 15 | 3171 |
| 65 | F V A V S N P L R | 15 | 3172 |
| 77 | I L T D S R I A Q | 15 | 3173 |
| 102 | V A L L I R L S Y | 15 | 3174 |
| 136 | I N S A V G L T A | 15 | 3175 |
| 155 | L I L L S Y V L I | 15 | 3176 |
| 157 | L L S Y V L I I R | 15 | 3177 |
| 30 | N V R E I S F N A | 14 | 3178 |
| 45 | F I K F F T V M E | 14 | 3179 |
| 67 | A V S N P L R Y A | 14 | 3180 |
| 91 | V I R G L L M L T | 14 | 3181 |
| 115 | V L H H S Y C Y H | 14 | 3182 |
| 125 | D V M K L S C T D | 14 | 3183 |
| 128 | K L S C T D T R I | 14 | 3184 |
| 194 | Y I P L I S L S I | 14 | 3185 |
| 200 | L S I V H R F G K | 14 | 3186 |
| 205 | R F G K Q A P A Y | 14 | 3187 |
| 223 | L L I S P L M N P | 14 | 3188 |
| 226 | S P L M N P V I Y | 14 | 3189 |
| 232 | V I Y S V K T K Q | 14 | 3190 |
| 25 | S I F W F N V R E | 13 | 3191 |
| 61 | A F D R F V A V S | 13 | 3192 |
| 62 | F D R F V A V S N | 13 | 3193 |
| 71 | P L R Y A M I L T | 13 | 3194 |
| 72 | L R Y A M I L T D | 13 | 3195 |
| 94 | G L L M L T P M V | 13 | 3196 |
| 135 | R I N S A V G L T | 13 | 3197 |
| 148 | T V G V D L L L I | 13 | 3198 |
| 183 | C V S H I V A F A | 13 | 3199 |
| 185 | S H I V A F A I Y | 13 | 3200 |
| 187 | I V A F A I Y Y I | 13 | 3201 |
| 199 | S L S I V H R F G | 13 | 3202 |
| 207 | G K Q A P A Y V H | 13 | 3203 |
| 213 | Y V H T M I A N T | 13 | 3204 |
| 214 | V H T M I A N T Y | 13 | 3205 |
| 217 | M I A N T Y L L I | 13 | 3206 |
| 245 | V I K I L H S K E | 13 | 3207 |
| 34 | I S F N A C L S H | 12 | 3208 |
| 87 | G V A S V I R G L | 12 | 3209 |
| 89 | A S V I R G L L M | 12 | 3210 |
| 101 | M V A L L I R L S | 12 | 3211 |
| 105 | L I R L S Y C H S | 12 | 3212 |
| 172 | S P E E R K E T F | 12 | 3213 |
| 201 | S I V H R F G K Q | 12 | 3214 |
| 15 | L S I S T L V T M | 11 | 3215 |
| 16 | S I S T L V T M L | 11 | 3216 |
| 23 | M L S I F W F N V | 11 | 3217 |
| 24 | L S I F W F N V R | 11 | 3218 |
| 33 | E I S F N A C L S | 11 | 3219 |
| 54 | S S V L L A M A F | 11 | 3220 |
| 81 | S R I A Q I G V A | 11 | 3221 |
| 133 | D T R I N S A V G | 11 | 3222 |
| 134 | T R I N S A V G L | 11 | 3223 |
| 138 | S A V G L T A M F | 11 | 3224 |
| 150 | G V D L L L I L L | 11 | 3225 |
| 208 | K Q A P A Y V H T | 11 | 3226 |
| 224 | L I S P L M N P V | 11 | 3227 |
| 227 | P L M N P V I Y S | 11 | 3228 |
| 238 | T K Q I R R A V I | 11 | 3229 |
| 9 | S A T D L G L S I | 10 | 3230 |
| 20 | L V T M L S I F W | 10 | 3231 |
| 32 | R E I S F N A C L | 10 | 3232 |
| 66 | V A V S N P L R Y | 10 | 3233 |
| 75 | A M I L T D S R I | 10 | 3234 |
| 76 | M I L T D S R I A | 10 | 3235 |
| 83 | I A Q I G V A S V | 10 | 3236 |
| 92 | I R G L L M L T P | 10 | 3237 |
| 127 | M K L S C T D T R | 10 | 3238 |

TABLE XIXA, PART 1-continued

| Pos | 1 2 3 4 5 6 7 8 9 | score | SEQ ID |
|---|---|---|---|
| 165 | R T V L S V A S P | 10 | 3239 |
| 167 | V L S V A S P E E | 10 | 3240 |
| 178 | E T F S T C V S H | 10 | 3241 |
| 10 | A T D L G L S I S | 9 | 3242 |
| 59 | A M A F D R F V A | 9 | 3243 |
| 70 | N P L R Y A M I L | 9 | 3244 |
| 109 | S Y C H S Q V L H | 9 | 3245 |
| 175 | E R K E T F S T C | 9 | 3246 |
| 182 | T C V S H I V A F | 9 | 3247 |
| 192 | I Y Y I P L I S L | 9 | 3248 |
| 193 | Y Y I P L I S L S | 9 | 3249 |
| 242 | R R A V I K I L H | 9 | 3250 |
| 243 | R A V I K I L H S | 9 | 3251 |
| 18 | S T L V T M L S I | 8 | 3252 |
| 28 | W F N V R E I S F | 8 | 3253 |
| 44 | F F I K F F T V M | 8 | 3254 |
| 60 | M A F D R F V A V | 8 | 3255 |
| 69 | S N P L R Y A M I | 8 | 3256 |
| 78 | L T D S R I A Q I | 8 | 3257 |
| 93 | R G L L M L T P M | 8 | 3258 |
| 108 | L S Y C H S Q V L | 8 | 3259 |
| 112 | H S Q V L H H S Y | 8 | 3260 |
| 144 | A M F S T V G V D | 8 | 3261 |
| 145 | M F S T V G V D L | 8 | 3262 |
| 195 | I P L I S L S I V | 8 | 3263 |
| 198 | I S L S I V H R F | 8 | 3264 |
| 209 | Q A P A Y V H T M | 8 | 3265 |
| 220 | N T Y L L I S P L | 8 | 3266 |
| 241 | I R R A V I K I L | 8 | 3267 |
| 49 | F T V M E S S V L | 7 | 3268 |
| 64 | R F V A V S N P L | 7 | 3269 |
| 74 | Y A M I L T D S R | 7 | 3270 |
| 96 | L M L T P M V A L | 7 | 3271 |
| 98 | L T P M V A L L I | 7 | 3272 |
| 99 | T P M V A L L I R | 7 | 3273 |
| 110 | Y C H S Q V L H H | 7 | 3274 |
| 132 | T D T R I N S A V | 7 | 3275 |
| 147 | S T V G V D L L L | 7 | 3276 |
| 164 | I R T V L S V A S | 7 | 3277 |
| 168 | L S V A S P E E R | 7 | 3278 |
| 177 | K E T F S T C V S | 7 | 3279 |
| 210 | A P A Y V H T M I | 7 | 3280 |
| 225 | I S P L M N P V I | 7 | 3281 |
| 2 | Y Y F L S M L S A | 6 | 3282 |
| 3 | Y F L S M L S A T | 6 | 3283 |
| 11 | T D L G L S I S T | 6 | 3284 |
| 21 | V T M L S I F W F | 6 | 3285 |
| 29 | F N V R E I S F N | 6 | 3286 |
| 35 | S F N A C L S H M | 6 | 3287 |
| 36 | F N A C L S H M F | 6 | 3288 |
| 37 | N A C L S H M F F | 6 | 3289 |
| 43 | M F F I K F F T V | 6 | 3290 |
| 47 | K F F T V M E S S | 6 | 3291 |
| 73 | R Y A M I L T D S | 6 | 3292 |
| 79 | T D S R I A Q I G | 6 | 3293 |
| 106 | I R L S Y C H S Q | 6 | 3294 |
| 119 | S Y C Y H P D V M | 6 | 3295 |
| 142 | L T A M F S T V G | 6 | 3296 |
| 151 | V D L L L I L L S | 6 | 3297 |
| 159 | S Y V L I I R T V | 6 | 3298 |
| 184 | V S H I V A F A I | 6 | 3299 |
| 203 | V H R F G K Q A P | 6 | 3300 |
| 204 | H R F G K Q A P A | 6 | 3301 |
| 228 | L M N P V I Y S V | 6 | 3302 |
| 233 | I Y S V K T K Q I | 6 | 3303 |
| 237 | K T K Q I R R A V | 6 | 3304 |
| 246 | I K I L H S K E T | 6 | 3305 |
| 1 | M Y Y F L S M L S | 5 | 3306 |
| 5 | L S M L S A T D L | 5 | 3307 |
| 17 | I S T L V T M L S | 5 | 3308 |
| 38 | A C L S H M F F I | 5 | 3309 |
| 41 | S H M F F I K F F | 5 | 3310 |
| 48 | F F T V M E S S V | 5 | 3311 |
| 52 | M E S S V L L A M | 5 | 3312 |
| 68 | V S N P L R Y A M | 5 | 3313 |
| 113 | S Q V L H H S Y C | 5 | 3314 |
| 123 | H P D V M K L S C | 5 | 3315 |

TABLE XIXA, PART 1-continued

| Pos | 1 2 3 4 5 6 7 8 9 | score | SEQ ID |
|---|---|---|---|
| 137 | N S A V G L T A M | 5 | 3316 |
| 171 | A S P E E R K E T | 5 | 3317 |
| 173 | P E E R K E T F S | 5 | 3318 |
| 174 | E E R K E T F S T | 5 | 3319 |
| 176 | R K E T F S T C V | 5 | 3320 |
| 181 | S T C V S H I V A | 5 | 3321 |
| 189 | A F A I Y Y I P L | 5 | 3322 |
| 206 | F G K Q A P A Y V | 5 | 3323 |
| 211 | P A Y V H T M I A | 5 | 3324 |
| 216 | T M I A N T Y L L | 5 | 3325 |
| 218 | I A N T Y L L I S | 5 | 3326 |
| 219 | A N T Y L L I S P | 5 | 3327 |
| 230 | N P V I Y S V K T | 5 | 3328 |
| 40 | L S H M F F I K F | 4 | 3329 |
| 53 | E S S V L L A M A | 4 | 3330 |
| 80 | D S R I A Q I G V | 4 | 3331 |
| 86 | I G V A S V I R G | 4 | 3332 |
| 118 | H S Y C Y H P D V | 4 | 3333 |
| 121 | C Y H P D V M K L | 4 | 3334 |
| 124 | P D V M K L S C T | 4 | 3335 |
| 131 | C T D T R I N S A | 4 | 3336 |
| 140 | V G L T A M F S T | 4 | 3337 |
| 143 | T A M F S T V G V | 4 | 3338 |
| 149 | V G V D L L L I L | 4 | 3339 |
| 158 | L S Y V L I I R T | 4 | 3340 |
| 212 | A Y V H T M I A N | 4 | 3341 |
| 234 | Y S V K T K Q I R | 4 | 3342 |
| 6 | S M L S A T D L G | 3 | 3343 |
| 13 | L G L S I S T L V | 3 | 3344 |
| 27 | F W F N V R E I S | 3 | 3345 |
| 46 | I K F F T V M E S | 3 | 3346 |
| 51 | V M E S S V L L A | 3 | 3347 |
| 63 | D R F V A V S N P | 3 | 3348 |
| 126 | V M K L S C T D T | 3 | 3349 |
| 130 | S C T D T R I N S | 3 | 3350 |
| 170 | V A S P E E R K E | 3 | 3351 |
| 179 | T F S T C V S H I | 3 | 3352 |
| 190 | F A I Y Y I P L I | 3 | 3353 |
| 221 | T Y L L I S P L M | 3 | 3354 |
| 8 | L S A T D L G L S | 2 | 3355 |
| 22 | T M L S I F W F N | 2 | 3356 |
| 26 | I F W F N V R E I | 2 | 3357 |
| 31 | V R E I S F N A C | 2 | 3358 |
| 58 | L A M A F D R F V | 2 | 3359 |
| 88 | V A S V I R G L L | 2 | 3360 |
| 100 | P M V A L L I R L | 2 | 3361 |
| 122 | Y H P D V M K L S | 2 | 3362 |
| 146 | F S T V G V D L L | 2 | 3363 |
| 188 | V A F A I Y Y I P | 2 | 3364 |
| 215 | H T M I A N T Y L | 2 | 3365 |
| 111 | C H S Q V L H H S | 1 | 3366 |
| 180 | F S T C V S H I V | 1 | 3367 |
| HLA-B*0702 9-mers v.1: 238P1B2 | | | |
| 70 | N P L R Y A M I L | 20 | 3368 |
| 210 | A P A Y V H T M I | 20 | 3369 |
| 230 | N P V I Y S V K T | 18 | 3370 |
| 195 | I P L I S L S I V | 17 | 3371 |
| 96 | L M L T P M V A L | 16 | 3372 |
| 172 | S P E E R K E T F | 16 | 3373 |
| 7 | M L S A T D L G L | 15 | 3374 |
| 145 | M F S T V G V D L | 15 | 3375 |
| 16 | S I S T L V T M L | 14 | 3376 |
| 147 | S T V G V D L L L | 14 | 3377 |
| 189 | A F A I Y Y I P L | 14 | 3378 |
| 192 | I Y Y I P L I S L | 14 | 3379 |
| 241 | I R R A V I K I L | 14 | 3380 |
| 50 | T V M E S S V L L | 13 | 3381 |
| 64 | R F V A V S N P L | 13 | 3382 |
| 67 | A V S N P L R Y A | 13 | 3383 |
| 88 | V A S V I R G L L | 13 | 3384 |
| 97 | M L T P M V A L L | 13 | 3385 |
| 99 | T P M V A L L I R | 13 | 3386 |
| 123 | H P D V M K L S C | 13 | 3387 |
| 136 | I N S A V G L T A | 13 | 3388 |
| 160 | Y V L I I R T V L | 13 | 3389 |
| 5 | L S M L S A T D L | 12 | 3390 |
| 14 | G L S I S T L V T | 12 | 3391 |

TABLE XIXA, PART 1-continued

| Pos | 1 2 3 4 5 6 7 8 9 | score | SEQ ID |
|---|---|---|---|
| 32 | R E I S F N A C L | 12 | 3392 |
| 90 | S V I R G L L M L | 12 | 3393 |
| 121 | C Y H P D V M K L | 12 | 3394 |
| 134 | T R I N S A V G L | 12 | 3395 |
| 149 | V G V D L L L I L | 12 | 3396 |
| 215 | H T M I A N T Y L | 12 | 3397 |
| 216 | T M I A N T Y L L | 12 | 3398 |
| 226 | S P L M N P V I Y | 12 | 3399 |
| 12 | D L G L S I S T L | 11 | 3400 |
| 49 | F T V M E S S V L | 11 | 3401 |
| 52 | M E S S V L L A M | 11 | 3402 |
| 59 | A M A F D R F V A | 11 | 3403 |
| 84 | A Q I G V A S V I | 11 | 3404 |
| 87 | G V A S V I R G L | 11 | 3405 |
| 89 | A S V I R G L L M | 11 | 3406 |
| 100 | P M V A L L I R L | 11 | 3407 |
| 108 | L S Y C H S Q V L | 11 | 3408 |
| 146 | F S T V G V D L L | 11 | 3409 |
| 150 | G V D L L L I L L | 11 | 3410 |
| 154 | L L I L L S Y V L | 11 | 3411 |
| 174 | E E R K E T F S T | 11 | 3412 |
| 183 | C V S H I V A F A | 11 | 3413 |
| 208 | K Q A P A Y V H T | 11 | 3414 |
| 220 | N T Y L L I S P L | 11 | 3415 |
| 44 | F F I K F F T V M | 10 | 3416 |
| 53 | E S S V L L A M A | 10 | 3417 |
| 60 | M A F D R F V A V | 10 | 3418 |
| 91 | V I R G L L M L T | 10 | 3419 |
| 128 | K L S C T D T R I | 10 | 3420 |
| 138 | S A V G L T A M F | 10 | 3421 |
| 143 | T A M F S T V G V | 10 | 3422 |
| 156 | I L L S Y V L I I | 10 | 3423 |
| 163 | I I R T V L S V A | 10 | 3424 |
| 204 | H R F G K Q A P A | 10 | 3425 |
| 224 | L I S P L M N P V | 10 | 3426 |
| 233 | I Y S V K T K Q I | 10 | 3427 |
| 9 | S A T D L G L S I | 9 | 3428 |
| 38 | A C L S H M F F I | 9 | 3429 |
| 51 | V M E S S V L L A | 9 | 3430 |
| 58 | L A M A F D R F V | 9 | 3431 |
| 68 | V S N P L R Y A M | 9 | 3432 |
| 83 | I A Q I G V A S V | 9 | 3433 |
| 93 | R G L L M L T P M | 9 | 3434 |
| 107 | R L S Y C H S Q V | 9 | 3435 |
| 137 | N S A V G L T A M | 9 | 3436 |
| 148 | T V G V D L L L I | 9 | 3437 |
| 162 | L I I R T V L S V | 9 | 3438 |
| 171 | A S P E E R K E T | 9 | 3439 |
| 179 | T F S T C V S H I | 9 | 3440 |
| 182 | T C V S H I V A F | 9 | 3441 |
| 217 | M I A N T Y L L I | 9 | 3442 |
| 225 | I S P L M N P V I | 9 | 3443 |
| 237 | K T K Q I R R A V | 9 | 3444 |
| 238 | T K Q I R R A V I | 9 | 3445 |
| 240 | Q I R R A V I K I | 9 | 3446 |
| 2 | Y Y F L S M L S A | 8 | 3447 |
| 11 | T D L G L S I S T | 8 | 3448 |
| 15 | L S I S T L V T M | 8 | 3449 |
| 18 | S T L V T M L S I | 8 | 3450 |
| 23 | M L S I F W F N V | 8 | 3451 |
| 26 | I F W F N V R E I | 8 | 3452 |
| 30 | N V R E I S F N A | 8 | 3453 |
| 41 | S H M F F I K F F | 8 | 3454 |
| 57 | L L A M A F D R F | 8 | 3455 |
| 71 | P L R Y A M I L T | 8 | 3456 |
| 75 | A M I L T D S R I | 8 | 3457 |
| 78 | L T D S R I A Q I | 8 | 3458 |
| 80 | D S R I A Q I G V | 8 | 3459 |
| 81 | S R I A Q I G V A | 8 | 3460 |
| 94 | G L L M L T P M V | 8 | 3461 |
| 95 | L L M L T P M V A | 8 | 3462 |
| 98 | L T P M V A L L I | 8 | 3463 |
| 135 | R I N S A V G L T | 8 | 3464 |
| 141 | G L T A M F S T V | 8 | 3465 |
| 155 | L I L L S Y V L I | 8 | 3466 |
| 176 | R K E T F S T C V | 8 | 3467 |
| 187 | I V A F A I Y Y I | 8 | 3468 |

TABLE XIXA, PART 1-continued

| Pos | 1 2 3 4 5 6 7 8 9 | score | SEQ ID |
|---|---|---|---|
| 194 | Y I P L I S L S I | 8 | 3469 |
| 198 | I S L S I V H R F | 8 | 3470 |
| 202 | I V H R F G K Q A | 8 | 3471 |
| 209 | Q A P A Y V H T M | 8 | 3472 |
| 3 | Y F L S M L S A T | 7 | 3473 |
| 13 | L G L S I S T L V | 7 | 3474 |
| 21 | V T M L S I F W F | 7 | 3475 |
| 35 | S F N A C L S H M | 7 | 3476 |
| 36 | F N A C L S H M F | 7 | 3477 |
| 37 | N A C L S H M F F | 7 | 3478 |
| 40 | L S H M F F I K F | 7 | 3479 |
| 42 | H M F F I K F F T | 7 | 3480 |
| 43 | M F F I K F F T V | 7 | 3481 |
| 54 | S S V L L A M A F | 7 | 3482 |
| 69 | S N P L R Y A M I | 7 | 3483 |
| 118 | H S Y C Y H P D V | 7 | 3484 |
| 119 | S Y C Y H P D V M | 7 | 3485 |
| 126 | V M K L S C T D T | 7 | 3486 |
| 131 | C T D T R I N S A | 7 | 3487 |
| 132 | T D T R I N S A V | 7 | 3488 |
| 181 | S T C V S H I V A | 7 | 3489 |
| 184 | V S H I V A F A I | 7 | 3490 |
| 190 | F A I Y Y I P L I | 7 | 3491 |
| 206 | F G K Q A P A Y V | 7 | 3492 |
| 211 | P A Y V H T M I A | 7 | 3493 |
| 213 | Y V H T M I A N T | 7 | 3494 |
| 221 | T Y L L T S P L M | 7 | 3495 |
| 228 | L M N P V I Y S V | 7 | 3496 |
| 236 | V K T K Q I R R A | 7 | 3497 |
| 246 | I K I L H S K E T | 7 | 3498 |
| 19 | T L V T M L S I F | 6 | 3499 |
| 28 | W F N V R E I S F | 6 | 3500 |
| 48 | F F T V M E S S V | 6 | 3501 |
| 61 | A F D R F V A V S | 6 | 3502 |
| 76 | M I L T D S R I A | 6 | 3503 |
| 82 | R I A Q I G V A S | 6 | 3504 |
| 124 | P D V M K L S C T | 6 | 3505 |
| 140 | V G L T A M F S T | 6 | 3506 |
| 153 | L L L I L L S Y V | 6 | 3507 |
| 158 | L S Y V L I I R T | 6 | 3508 |
| 159 | S Y V L I I R T V | 6 | 3509 |
| 180 | F S T C V S H I V | 6 | 3510 |
| 120 | Y C Y H P D V M K | 5 | 3511 |
| 205 | R F G K Q A P A Y | 5 | 3512 |
| 207 | G K Q A P A Y V H | 5 | 3513 |
| 227 | P L M N P V I Y S | 5 | 3514 |
| 62 | F D R F V A V S N | 4 | 3515 |
| 92 | I R G L L M L T P | 4 | 3516 |
| 133 | D T R I N S A V G | 4 | 3517 |
| 139 | A V G L T A M F S | 4 | 3518 |
| 144 | A M F S T V G V D | 4 | 3519 |
| 164 | I R T V L S V A S | 4 | 3520 |
| 169 | S V A S P E E R K | 4 | 3521 |
| 191 | A I Y Y I P L I S | 4 | 3522 |
| 197 | L I S L S I V H R | 4 | 3523 |
| 4 | F L S M L S A T D | 3 | 3524 |
| 10 | A T D L G L S I S | 3 | 3525 |
| 33 | E I S F N A C L S | 3 | 3526 |
| 34 | I S F N A C L S H | 3 | 3527 |
| 39 | C L S H M F F I K | 3 | 3528 |
| 45 | F I K F F T V M E | 3 | 3529 |
| 72 | L R Y A M I L T D | 3 | 3530 |
| 73 | R Y A M I L T D S | 3 | 3531 |
| 77 | I L T D S R I A Q | 3 | 3532 |
| 85 | Q I G V A S V I R | 3 | 3533 |
| 86 | I G V A S V I R Q | 3 | 3534 |
| 102 | V A L L I R L S Y | 3 | 3535 |
| 110 | Y C H S Q V L H H | 3 | 3536 |
| 117 | H H S Y C Y H P D | 3 | 3537 |
| 142 | L T A M F S T V G | 3 | 3538 |
| 161 | V L I I R T V L S | 3 | 3539 |
| 165 | R T V L S V A S P | 3 | 3540 |
| 167 | V L S V A S P E E | 3 | 3541 |
| 170 | V A S P E E R K E | 3 | 3542 |
| 177 | K E T F S T C V S | 3 | 3543 |
| 178 | E T F S T C V S H | 3 | 3544 |
| 199 | S L S I V H R F G | 3 | 3545 |

TABLE XIXA, PART 1-continued

| Pos | 1 2 3 4 5 6 7 8 9 | score | SEQ ID |
|---|---|---|---|
| 203 | V H R F G K Q A P | 3 | 3546 |
| 212 | A Y V H T M I A N | 3 | 3547 |
| 218 | I A N T Y L L I S | 3 | 3548 |
| 223 | L L I S P L M N P | 3 | 3549 |
| 239 | K Q I R R A V I K | 3 | 3550 |
| 243 | R A V I K I L H S | 3 | 3551 |
| 244 | A V I K I L H S K | 3 | 3552 |
| 17 | I S T L V T M L S | 2 | 3553 |
| 22 | T M L S I F W F N | 2 | 3554 |
| 24 | L S I F W F N V R | 2 | 3555 |
| 25 | S I F W F N V R E | 2 | 3556 |
| 31 | V R E I S F N A C | 2 | 3557 |
| 46 | I K F F T V M E S | 2 | 3558 |
| 55 | S V L L A M A F D | 2 | 3559 |
| 65 | F V A V S N P L R | 2 | 3560 |
| 66 | V A V S N P L R Y | 2 | 3561 |
| 74 | Y A M I L T D S R | 2 | 3562 |
| 79 | T D S R I A Q I G | 2 | 3563 |
| 103 | A L L I R L S Y C | 2 | 3564 |
| 105 | L I R L S Y C H S | 2 | 3565 |
| 109 | S Y C H S Q V L H | 2 | 3566 |
| 111 | C H S Q V L H H S | 2 | 3567 |
| 125 | D V M K L S C T D | 2 | 3568 |
| 151 | V D L L L I L L S | 2 | 3569 |
| 152 | D L L L I L L S Y | 2 | 3570 |
| 157 | L L S Y V L I I R | 2 | 3571 |
| 173 | P E E R K E T F S | 2 | 3572 |
| 175 | E R K E T F S T C | 2 | 3573 |
| 185 | S H I V A F A I Y | 2 | 3574 |
| 219 | A N T Y L L I S P | 2 | 3575 |
| 222 | Y L L I S P L M N | 2 | 3576 |
| 242 | R R A V I K I L H | 2 | 3577 |
| 6 | S M L S A T D L G | 1 | 3578 |
| 8 | L S A T D L G L S | 1 | 3579 |
| 20 | L V T M L S I F W | 1 | 3580 |
| 27 | F W F N V R E I S | 1 | 3581 |
| 29 | F N V R E I S F N | 1 | 3582 |
| 47 | K F F T V M E S S | 1 | 3583 |
| 56 | V L L A M A F D R | 1 | 3584 |

TABLE XIXA, PART 1-continued

| Pos | 1 2 3 4 5 6 7 8 9 | score | SEQ ID |
|---|---|---|---|
| 63 | D R F V A V S N P | 1 | 3585 |
| 101 | M V A L L I R L S | 1 | 3586 |
| 106 | I R L S Y C H S Q | 1 | 3587 |
| 127 | M K L S C T D T R | 1 | 3588 |
| 129 | L S C T D T R I N | 1 | 3589 |
| 130 | S C T D T R I N S | 1 | 3590 |
| 166 | T V L S V A S P E | 1 | 3591 |
| 168 | L S V A S P E E R | 1 | 3592 |
| 186 | H I V A F A I Y Y | 1 | 3593 |
| 188 | V A F A I Y Y I P | 1 | 3594 |
| 193 | Y Y I P L I S L S | 1 | 3595 |
| 196 | P L I S L S I V H | 1 | 3596 |
| 200 | L S I V H R F G K | 1 | 3597 |
| 201 | S I V H R F G K Q | 1 | 3598 |
| 229 | M N P V I Y S V K | 1 | 3599 |
| 231 | P V I Y S V K T K | 1 | 3600 |
| 232 | V I Y S V K T K Q | 1 | 3601 |
| 234 | Y S V K T K Q I R | 1 | 3602 |
| HLA-B*08 9-mers v.1: 238P1B2 | | | |
| 172 | S P E E R K E T F | 24 | 3603 |
| 235 | S V K T K Q I R R | 22 | 3604 |
| 233 | I Y S V K T K Q I | 19 | 3605 |
| 241 | I R R A V I K I L | 19 | 3606 |
| 12 | D L G L S I S T L | 18 | 3607 |
| 16 | S I S T L V T M L | 17 | 3608 |
| 69 | S N P L R Y A M I | 17 | 3609 |
| 97 | M L T P M V A L L | 17 | 3610 |
| 154 | L L I L L S Y V L | 17 | 3611 |
| 240 | Q I R R A V I K I | 17 | 3612 |
| 7 | M L S A T D L G L | 16 | 3613 |
| 45 | F I K F F T V M E | 16 | 3614 |
| 70 | N P L R Y A M I L | 16 | 3615 |
| 88 | V A S V I R G L L | 16 | 3616 |
| 161 | V L I I R T V L S | 16 | 3617 |
| 28 | W F N V R E I S F | 15 | 3618 |
| 78 | L T D S R I A Q I | 15 | 3619 |
| 243 | R A V I K I L H S | 15 | 3620 |
| 245 | V I K I L H S K E | 15 | 3621 |

TABLE XIXA, PART 1-continued

| Pos | 1 2 3 4 5 6 7 8 9 | score | SEQ ID |
|---|---|---|---|
| 60 | M A F D R F V A V | 14 | 3622 |
| 103 | A L L I R L S Y C | 14 | 3623 |
| 156 | I L L S Y V L I I | 14 | 3624 |
| 175 | E R K E T F S T C | 14 | 3625 |
| 201 | S I V H R F G K Q | 14 | 3626 |
| 238 | T K Q I R R A V I | 14 | 3627 |
| 50 | T V M E S S V L L | 13 | 3628 |
| 71 | P L R Y A M I L T | 13 | 3629 |
| 146 | F S T V G V D L L | 13 | 3630 |
| 190 | F A I Y Y I P L I | 13 | 3631 |
| 210 | A P A Y V H T M I | 13 | 3632 |
| 9 | S A T D L G L S I | 12 | 3633 |
| 19 | T L V T M L S I F | 12 | 3634 |
| 57 | L L A M A F D R F | 12 | 3635 |
| 87 | G V A S V I R G L | 12 | 3636 |
| 90 | S V I R G L L M L | 12 | 3637 |
| 96 | L M L T P M V A L | 12 | 3638 |
| 126 | V M K L S C T D T | 12 | 3639 |
| 128 | K L S C T D T R I | 12 | 3640 |
| 138 | S A V G L T A M F | 12 | 3641 |
| 147 | S T V G V D L L L | 12 | 3642 |
| 150 | G V D L L L I L L | 12 | 3643 |
| 155 | L I L L S Y V L I | 12 | 3644 |
| 215 | H T M I A N T Y L | 12 | 3645 |
| 220 | N T Y L L I S P L | 12 | 3646 |
| 5 | L S M L S A T D L | 11 | 3647 |
| 32 | R E I S F N A C L | 11 | 3648 |
| 37 | N A C L S H M F F | 11 | 3649 |
| 49 | F T V M E S S V L | 11 | 3650 |
| 91 | V I R G L L M L T | 11 | 3651 |
| 105 | L I R L S Y C H S | 11 | 3652 |
| 121 | C Y H P D V M K L | 11 | 3653 |
| 134 | T R I N S A V G L | 11 | 3654 |
| 145 | M F S T V G V D L | 11 | 3655 |
| 149 | V G V D L L L I L | 11 | 3656 |
| 163 | I I R T V L S V A | 11 | 3657 |
| 192 | I Y Y I P L I S L | 11 | 3658 |
| 194 | Y I P L I S L S I | 11 | 3659 |
| 204 | H R F G K Q A P A | 11 | 3660 |
| 206 | F G K Q A P A Y V | 11 | 3661 |
| 237 | K T K Q I R R A V | 11 | 3662 |
| 41 | S H M F F I K F F | 10 | 3663 |
| 43 | M F F I K F F T V | 10 | 3664 |
| 54 | S S V L L A M A F | 10 | 3665 |
| 64 | R F V A V S N P L | 10 | 3666 |
| 100 | P M V A L L I R L | 10 | 3667 |
| 108 | L S Y C H S Q V L | 10 | 3668 |
| 124 | P D V M K L S C T | 10 | 3669 |
| 160 | Y V L I I R T V L | 10 | 3670 |
| 173 | P E E R K E T F S | 10 | 3671 |
| 189 | A F A I Y Y I P L | 10 | 3672 |
| 216 | T M I A N T Y L L | 10 | 3673 |
| 217 | M I A N T Y L L I | 10 | 3674 |
| 18 | S T L V T M L S I | 9 | 3675 |
| 21 | V T M L S I F W F | 9 | 3676 |
| 26 | I F W F N V R E I | 9 | 3677 |
| 131 | C T D T R I N S A | 9 | 3678 |
| 167 | V L S V A S P E E | 9 | 3679 |
| 182 | T C V S H I V A F | 9 | 3680 |
| 225 | I S P L M N P V I | 9 | 3681 |
| 226 | S P L M N P V I Y | 9 | 3682 |
| 239 | K Q I R R A V I K | 9 | 3683 |
| 25 | S I F W F N V R E | 8 | 3684 |
| 30 | N V R E I S F N A | 8 | 3685 |
| 62 | F D R F V A V S N | 8 | 3686 |
| 77 | I L T D S R I A Q | 8 | 3687 |
| 89 | A S V I R G L L M | 8 | 3688 |
| 123 | H P D V M K L S C | 8 | 3689 |
| 174 | E E R K E T F S T | 8 | 3690 |
| 184 | V S H I V A F A I | 8 | 3691 |
| 187 | I V A F A I Y Y I | 8 | 3692 |
| 198 | I S L S I V H R F | 8 | 3693 |
| 199 | S L S I V H R F G | 8 | 3694 |
| 203 | V H R F G K Q A P | 8 | 3695 |
| 4 | F L S M L S A T D | 7 | 3696 |
| 14 | G L S I S T L V T | 7 | 3697 |
| 36 | F N A C L S H M F | 7 | 3698 |

TABLE XIXA, PART 1-continued

| Pos | 1 2 3 4 5 6 7 8 9 | score | SEQ ID |
|---|---|---|---|
| 56 | V L L A M A F D R | 7 | 3699 |
| 75 | A M I L T D S R I | 7 | 3700 |
| 94 | G L L M L T P M V | 7 | 3701 |
| 95 | L L M L T P M V A | 7 | 3702 |
| 99 | T P M V A L L I R | 7 | 3703 |
| 107 | R L S Y C H S Q V | 7 | 3704 |
| 115 | V L H H S Y C Y H | 7 | 3705 |
| 141 | G L T A M F S T V | 7 | 3706 |
| 148 | T V G V D L L L I | 7 | 3707 |
| 152 | D L L L I L L S Y | 7 | 3708 |
| 157 | L L S Y V L I I R | 7 | 3709 |
| 179 | T F S T C V S H I | 7 | 3710 |
| 195 | I P L I S L S I V | 7 | 3711 |
| 197 | L I S L S I V H R | 7 | 3712 |
| 227 | P L M N P V I Y S | 7 | 3713 |
| 230 | N P V I Y S V K T | 7 | 3714 |
| 23 | M L S I F W F N V | 6 | 3715 |
| 33 | E I S F N A C L S | 6 | 3716 |
| 38 | A C L S H M F F I | 6 | 3717 |
| 39 | C L S H M F F I K | 6 | 3718 |
| 40 | L S H M F F I K F | 6 | 3719 |
| 80 | D S R I A Q I G V | 6 | 3720 |
| 82 | R I A Q I G V A S | 6 | 3721 |
| 83 | I A Q I G V A S V | 6 | 3722 |
| 84 | A Q I G V A S V I | 6 | 3723 |
| 85 | Q I G V A S V I R | 6 | 3724 |
| 98 | L T P M V A L L I | 6 | 3725 |
| 102 | V A L L I R L S Y | 6 | 3726 |
| 104 | L L I R L S Y C H | 6 | 3727 |
| 133 | D T R I N S A V G | 6 | 3728 |
| 153 | L L L I L L S Y V | 6 | 3729 |
| 196 | P L I S L S I V H | 6 | 3730 |
| 222 | Y L L I S P L M N | 6 | 3731 |
| 223 | L L I S P L M N P | 6 | 3732 |
| 66 | V A V S N P L R Y | 5 | 3733 |
| 135 | R I N S A V G L T | 5 | 3734 |
| 143 | T A M F S T V G V | 5 | 3735 |
| 162 | L I I R T V L S V | 5 | 3736 |
| 170 | V A S P E E R K E | 5 | 3737 |
| 186 | H I V A F A I Y Y | 5 | 3738 |
| 188 | V A F A I Y Y I P | 5 | 3739 |
| 191 | A I Y Y I P L I S | 5 | 3740 |
| 209 | Q A P A Y V H T M | 5 | 3741 |
| 211 | P A Y V H T M I A | 5 | 3742 |
| 218 | I A N T Y L L I S | 5 | 3743 |
| 232 | V I Y S V K T K Q | 5 | 3744 |
| 58 | L A M A F D R F V | 4 | 3745 |
| 74 | Y A M I L T D S R | 4 | 3746 |
| 76 | M I L T D S R I A | 4 | 3747 |
| 159 | S Y V L I I R T V | 4 | 3748 |
| 164 | I R T V L S V A S | 4 | 3749 |
| 171 | A S P E E R K E T | 4 | 3750 |
| 224 | L I S P L M N P V | 4 | 3751 |
| 246 | I K I L H S K E T | 4 | 3752 |
| 46 | I K F F T V M E S | 3 | 3753 |
| 53 | E S S V L L A M A | 3 | 3754 |
| 55 | S V L L A M A F D | 3 | 3755 |
| 65 | F V A V S N P L R | 3 | 3756 |
| 81 | S R I A Q I G V A | 3 | 3757 |
| 109 | S Y C H S Q V L H | 3 | 3758 |
| 113 | S Q V L H H S Y C | 3 | 3759 |
| 119 | S Y C Y H P D V M | 3 | 3760 |
| 151 | V D L L L I L L S | 3 | 3761 |
| 178 | E T F S T C V S H | 3 | 3762 |
| 181 | S T C V S H I V A | 3 | 3763 |
| 185 | S H I V A F A I Y | 3 | 3764 |
| 231 | P V I Y S V K T K | 3 | 3765 |
| 6 | S M L S A T D L G | 2 | 3766 |
| 17 | I S T L V T M L S | 2 | 3767 |
| 29 | F N V R E I S F N | 2 | 3768 |
| 31 | V R E I S F N A C | 2 | 3769 |
| 35 | S F N A C L S H M | 2 | 3770 |
| 48 | F F T V M E S S V | 2 | 3771 |
| 51 | V M E S S V L L A | 2 | 3772 |
| 63 | D R F V A V S N P | 2 | 3773 |
| 68 | V S N P L R Y A M | 2 | 3774 |
| 86 | I G V A S V I R G | 2 | 3775 |

TABLE XIXA, PART 1-continued

| Pos | 1 2 3 4 5 6 7 8 9 | score | SEQ ID |
|---|---|---|---|
| 92 | I R G L L M L T P | 2 | 3776 |
| 101 | M V A L L I R L S | 2 | 3777 |
| 112 | H S Q V L H H S Y | 2 | 3778 |
| 117 | H H S Y C Y H P D | 2 | 3779 |
| 130 | S C T D T R I N S | 2 | 3780 |
| 132 | T D T R I N S A V | 2 | 3781 |
| 137 | N S A V Q L T A M | 2 | 3782 |
| 158 | L S Y V L I I R T | 2 | 3783 |
| 165 | R T V L S V A S P | 2 | 3784 |
| 169 | S V A S P E E R K | 2 | 3785 |
| 202 | I V H R F G K Q A | 2 | 3786 |
| 236 | V K T K Q I R R A | 2 | 3787 |
| 2 | Y Y F L S M L S A | 1 | 3788 |
| 3 | Y F L S M L S A T | 1 | 3789 |
| 10 | A T D L G L S I S | 1 | 3790 |
| 15 | L S I S T L V T M | 1 | 3791 |
| 27 | F W F N V R E I S | 1 | 3792 |
| 34 | I S F N A C L S H | 1 | 3793 |
| 42 | H M F F I K F F T | 1 | 3794 |
| 44 | F F I K F F T V M | 1 | 3795 |
| 52 | M E S S V L L A M | 1 | 3796 |
| 61 | A F D R F V A V S | 1 | 3797 |
| 72 | L R Y A M I L T D | 1 | 3798 |
| 93 | R G L L M L T P M | 1 | 3799 |
| 106 | I R L S Y C H S Q | 1 | 3800 |
| 110 | Y C H S Q V L H H | 1 | 3801 |
| 118 | H S Y C Y H P D V | 1 | 3802 |
| 120 | Y C Y H P D V M K | 1 | 3803 |
| 122 | Y H P D V M K L S | 1 | 3804 |
| 136 | I N S A V G L T A | 1 | 3805 |
| 139 | A V G L T A M F S | 1 | 3806 |
| 140 | V G L T A M F S T | 1 | 3807 |
| 144 | A M F S T V G V D | 1 | 3808 |
| 168 | L S V A S P E E R | 1 | 3809 |
| 180 | F S T C V S H I V | 1 | 3810 |
| 183 | C V S H I V A F A | 1 | 3811 |
| 193 | Y Y I P L I S L S | 1 | 3812 |
| 200 | L S I V H R F G K | 1 | 3813 |
| 205 | R F G K Q A P A Y | 1 | 3814 |

TABLE XIXA, PART 1-continued

| Pos | 1 2 3 4 5 6 7 8 9 | score | SEQ ID |
|---|---|---|---|
| 207 | G K Q A P A Y V H | 1 | 3815 |
| 208 | K Q A P A Y V H T | 1 | 3816 |
| 212 | A Y V H T M I A N | 1 | 3817 |
| 213 | Y V H T M I A N T | 1 | 3818 |
| 214 | V H T M I A N T Y | 1 | 3819 |
| 219 | A N T Y L L I S P | 1 | 3820 |
| 221 | T Y L L I S P L M | 1 | 3821 |
| 228 | L M N P V I Y S V | 1 | 3822 |
| 229 | M N P V I Y S V K | 1 | 3823 |
| 242 | R R A V I K I L H | 1 | 3824 |
| HLA-B*1510 9-mers v.1: 238P1B2 | | | |
| 41 | S H M F F I K F F | 17 | 3825 |
| 87 | G V A S V I R G L | 15 | 3826 |
| 96 | L M L T P M V A L | 15 | 3827 |
| 50 | T V M E S S V L L | 14 | 3828 |
| 160 | Y V L I I R T V L | 14 | 3829 |
| 88 | V A S V I R G L L | 13 | 3830 |
| 97 | M L T P M V A L L | 13 | 3831 |
| 121 | C Y H P D V M K L | 13 | 3832 |
| 122 | Y H P D V M K L S | 13 | 3833 |
| 134 | T R I N S A V G L | 13 | 3834 |
| 145 | M F S T V G V D L | 13 | 3835 |
| 146 | F S T V G V D L L | 13 | 3836 |
| 192 | I Y Y I P L I S L | 13 | 3837 |
| 203 | V H R F G K Q A P | 13 | 3838 |
| 241 | I R R A V I K I L | 13 | 3839 |
| 12 | D L G L S I S T L | 12 | 3840 |
| 16 | S I S T L V T M L | 12 | 3841 |
| 49 | F T V M E S S V L | 12 | 3842 |
| 100 | P M V A L L I R L | 12 | 3843 |
| 108 | L S Y C H S Q V L | 12 | 3844 |
| 111 | C H S Q V L H H S | 12 | 3845 |
| 154 | L L I L L S Y V L | 12 | 3846 |
| 216 | T M I A N T Y L L | 12 | 3847 |
| 7 | M L S A T D L G L | 11 | 3848 |
| 90 | S V I R G L L M L | 11 | 3849 |
| 117 | H H S Y C Y H P D | 11 | 3850 |
| 147 | S T V G V D L L L | 11 | 3851 |

TABLE XIXA, PART 1-continued

| Pos | 1 2 3 4 5 6 7 8 9 | score | SEQ ID |
|---|---|---|---|
| 149 | V G V D L L L I L | 11 | 3852 |
| 150 | G V D L L L I L L | 11 | 3853 |
| 182 | T C V S H I V A F | 11 | 3854 |
| 185 | S H I V A F A I Y | 11 | 3855 |
| 189 | A F A I Y Y I P L | 11 | 3856 |
| 198 | I S L S I V H R F | 11 | 3857 |
| 214 | V H T M I A N T Y | 11 | 3858 |
| 220 | N T Y L L I S P L | 11 | 3859 |
| 5 | L S M L S A T D L | 10 | 3860 |
| 32 | R E I S F N A C L | 10 | 3861 |
| 64 | R F V A V S N P L | 10 | 3862 |
| 68 | V S N P L R Y A M | 10 | 3863 |
| 70 | N P L R Y A M I L | 10 | 3864 |
| 116 | L H S Y C Y H P | 10 | 3865 |
| 137 | N S A V G L T A M | 10 | 3866 |
| 172 | S P E E R K E T F | 10 | 3867 |
| 215 | H T M I A N T Y L | 10 | 3868 |
| 15 | L S I S T L V T M | 9 | 3869 |
| 44 | F F I K F F T V M | 9 | 3870 |
| 57 | L L A M A F D R F | 9 | 3871 |
| 119 | S Y C Y H P D V M | 9 | 3872 |
| 52 | M E S S V L L A M | 8 | 3873 |
| 209 | Q A P A Y V H T M | 8 | 3874 |
| 221 | T Y L L I S P L M | 8 | 3875 |
| 19 | T L V T M L S I F | 7 | 3876 |
| 21 | V T M L S I F W F | 7 | 3877 |
| 26 | I F W F N V R E I | 7 | 3878 |
| 28 | W F N V R E I S F | 7 | 3879 |
| 36 | F N A C L S H M F | 7 | 3880 |
| 54 | S S V L L A M A F | 7 | 3881 |
| 138 | S A V G L T A M F | 7 | 3882 |
| 35 | S F N A C L S H M | 6 | 3883 |
| 37 | N A C L S H M F F | 6 | 3884 |
| 40 | L S H M F F I K F | 6 | 3885 |
| 89 | A S V I R G L L M | 6 | 3886 |
| 93 | R G L L M L T P M | 6 | 3887 |
| 164 | I R T V L S V A S | 6 | 3888 |
| 236 | V K T K Q I R R A | 6 | 3889 |
| 77 | I L T D S R I A Q | 5 | 3890 |
| 82 | R I A Q I G V A S | 5 | 3891 |
| 86 | I G V A S V I R G | 5 | 3892 |
| 170 | V A S P E E R K E | 5 | 3893 |
| 208 | K Q A P A Y V H T | 5 | 3894 |
| 225 | I S P L M N P V I | 5 | 3895 |
| 237 | K T K Q I R R A V | 5 | 3896 |
| 14 | G L S I S T L V T | 4 | 3897 |
| 25 | S I F W F N V R E | 4 | 3898 |
| 46 | I K F F T V M E S | 4 | 3899 |
| 59 | A M A F D R F V A | 4 | 3900 |
| 60 | M A F D R F V A V | 4 | 3901 |
| 66 | V A V S N P L R Y | 4 | 3902 |
| 67 | A V S N P L R Y A | 4 | 3903 |
| 83 | I A Q I G V A S V | 4 | 3904 |
| 92 | I R G L L M L T P | 4 | 3905 |
| 101 | M V A L L I R L S | 4 | 3906 |
| 120 | Y C Y H P D V M K | 4 | 3907 |
| 136 | I N S A V G L T A | 4 | 3908 |
| 158 | L S Y V L I I R T | 4 | 3909 |
| 159 | S Y V L I I R T V | 4 | 3910 |
| 163 | I I R T V L S V A | 4 | 3911 |
| 167 | V L S V A S P E E | 4 | 3912 |
| 169 | S V A S P E E R K | 4 | 3913 |
| 187 | I V A F A I Y Y I | 4 | 3914 |
| 193 | Y Y I P L I S L S | 4 | 3915 |
| 197 | L I S L S I V H R | 4 | 3916 |
| 207 | G K Q A P A Y V H | 4 | 3917 |
| 224 | L I S P L M N P V | 4 | 3918 |
| 226 | S P L M N P V I Y | 4 | 3919 |
| 233 | I Y S V K T K Q I | 4 | 3920 |
| 238 | T K Q I R R A V I | 4 | 3921 |
| 33 | E I S F N A C L S | 3 | 3922 |
| 53 | E S S V L L A M A | 3 | 3923 |
| 61 | A F D R F V A V S | 3 | 3924 |
| 65 | F V A V S N P L R | 3 | 3925 |
| 81 | S R I A Q I G V A | 3 | 3926 |
| 84 | A Q I G V A S V I | 3 | 3927 |
| 85 | Q I G V A S V I R | 3 | 3928 |

TABLE XIXA, PART 1-continued

| Pos | 1 2 3 4 5 6 7 8 9 | score | SEQ ID |
|---|---|---|---|
| 95 | L L M L T P M V A | 3 | 3929 |
| 128 | K L S C T D T R I | 3 | 3930 |
| 133 | D T R I N S A V G | 3 | 3931 |
| 142 | L T A M F S T V G | 3 | 3932 |
| 143 | T A M F S T V G V | 3 | 3933 |
| 144 | A M F S T V G V D | 3 | 3934 |
| 156 | I L L S Y V L I I | 3 | 3935 |
| 171 | A S P E E R K E T | 3 | 3936 |
| 175 | E R K E T F S T C | 3 | 3937 |
| 178 | E T F S T C V S H | 3 | 3938 |
| 179 | T F S T C V S H I | 3 | 3939 |
| 181 | S T C V S H I V A | 3 | 3940 |
| 199 | S L S I V H R F G | 3 | 3941 |
| 205 | R F G K Q A P A Y | 3 | 3942 |
| 228 | L M N P V I Y S V | 3 | 3943 |
| 229 | M N P V I Y S V K | 3 | 3944 |
| 234 | Y S V K T K Q I R | 3 | 3945 |
| 242 | R R A V I K I L H | 3 | 3946 |
| 246 | I K I L H S K E T | 3 | 3947 |
| 2 | Y Y F L S M L S A | 2 | 3948 |
| 3 | Y F L S M L S A T | 2 | 3949 |
| 4 | F L S M L S A T D | 2 | 3950 |
| 11 | T D L G L S I S T | 2 | 3951 |
| 17 | I S T L V T M L S | 2 | 3952 |
| 18 | S T L V T M L S I | 2 | 3953 |
| 24 | L S T F W F N V R | 2 | 3954 |
| 31 | V R E I S F N A C | 2 | 3955 |
| 34 | I S F N A C L S H | 2 | 3956 |
| 45 | F I K F F T V M E | 2 | 3957 |
| 51 | V M E S S V L L A | 2 | 3958 |
| 58 | L A M A F D R F V | 2 | 3959 |
| 62 | F D R F V A V S N | 2 | 3960 |
| 63 | D R F V A V S N P | 2 | 3961 |
| 72 | L R Y A M I L T D | 2 | 3962 |
| 75 | A M I L T D S R I | 2 | 3963 |
| 76 | M I L T D S R I A | 2 | 3964 |
| 79 | T D S R I A Q I G | 2 | 3965 |
| 94 | G L L M L T P M V | 2 | 3966 |
| 99 | T P M V A L L I R | 2 | 3967 |
| 106 | I R L S Y C H S Q | 2 | 3968 |
| 109 | S Y C H S Q V L H | 2 | 3969 |
| 110 | Y C H S Q V L H H | 2 | 3970 |
| 123 | H P D V M K L S C | 2 | 3971 |
| 125 | D V M K L S C T D | 2 | 3972 |
| 129 | L S C T D T R I N | 2 | 3973 |
| 130 | S C T D T R I N S | 2 | 3974 |
| 132 | T D T R I N S A V | 2 | 3975 |
| 141 | G L T A M F S T V | 2 | 3976 |
| 148 | T V G V D L L L I | 2 | 3977 |
| 155 | L I L L S Y V L I | 2 | 3978 |
| 161 | V L I I R T V L S | 2 | 3979 |
| 168 | L S V A S P E E R | 2 | 3980 |
| 174 | E E R K E T F S T | 2 | 3981 |
| 177 | K E T F S T C V S | 2 | 3982 |
| 183 | C V S H I V A F A | 2 | 3983 |
| 190 | F A I Y Y I P L I | 2 | 3984 |
| 195 | I P L I S L S I V | 2 | 3985 |
| 196 | P L I S L S I V H | 2 | 3986 |
| 200 | L S I V H R F G K | 2 | 3987 |
| 202 | T V H R F G K Q A | 2 | 3988 |
| 206 | F G K Q A P A Y V | 2 | 3989 |
| 212 | A Y V H T M I A N | 2 | 3990 |
| 213 | Y V H T M I A N T | 2 | 3991 |
| 218 | I A N T Y L L I S | 2 | 3992 |
| 222 | Y L L I S P L M N | 2 | 3993 |
| 227 | P L M N P V I Y S | 2 | 3994 |
| 230 | N P V I Y S V K T | 2 | 3995 |
| 231 | P V I Y S V K T K | 2 | 3996 |
| 235 | S V K T K Q I R R | 2 | 3997 |
| 239 | K Q I R R A V I K | 2 | 3998 |
| 8 | L S A T D L G L S | 1 | 3999 |
| 9 | S A T D L G L S I | 1 | 4000 |
| 10 | A T D L G L S I S | 1 | 4001 |
| 22 | T M L S I F W F N | 1 | 4002 |
| 23 | M L S I F W F N V | 1 | 4003 |
| 27 | F W F N V R E I S | 1 | 4004 |
| 29 | F N V R E I S F N | 1 | 4005 |

TABLE XIXA, PART 1-continued

| Pos | 1 2 3 4 5 6 7 8 9 | score | SEQ ID |
|---|---|---|---|
| 30 | N V R E I S F N A | 1 | 4006 |
| 38 | A C L S H M F F I | 1 | 4007 |
| 39 | C L S H M F F I K | 1 | 4008 |
| 42 | H M F F I K F F T | 1 | 4009 |
| 43 | M F F I K F F T V | 1 | 4010 |
| 47 | K F F T V M E S S | 1 | 4011 |
| 48 | F F T V M E S S V | 1 | 4012 |
| 55 | S V L L A M A F D | 1 | 4013 |
| 71 | P L R Y A M I L T | 1 | 4014 |
| 73 | R Y A M I L T D S | 1 | 4015 |
| 74 | Y A M I L T D S R | 1 | 4016 |
| 78 | L T D S R I A Q I | 1 | 4017 |
| 91 | V I R G L L M L T | 1 | 4018 |
| 102 | V A L L I R L S Y | 1 | 4019 |
| 107 | R L S Y C H S Q V | 1 | 4020 |
| 112 | H S Q V L H H S Y | 1 | 4021 |
| 118 | H S Y C Y H P D V | 1 | 4022 |
| 127 | M K L S C T D T R | 1 | 4023 |
| 131 | C T D T R I N S A | 1 | 4024 |
| 135 | R I N S A V G L T | 1 | 4025 |
| 140 | V G L T A M F S T | 1 | 4026 |
| 151 | V D L L L I L L S | 1 | 4027 |
| 157 | L L S Y V L I I R | 1 | 4028 |
| 162 | L I I R T V L S V | 1 | 4029 |
| 165 | R T V L S V A S P | 1 | 4030 |
| 166 | T V L S V A S P E | 1 | 4031 |
| 173 | P E E R K E T F S | 1 | 4032 |
| 176 | R K E T F S T C V | 1 | 4033 |
| 184 | V S H I V A F A I | 1 | 4034 |
| 191 | A I Y Y I P L I S | 1 | 4035 |
| 194 | Y I P L I S L S I | 1 | 4036 |
| 204 | H R F G K Q A P A | 1 | 4037 |
| 210 | A P A Y V H T M I | 1 | 4038 |
| 211 | P A Y V H T M I A | 1 | 4039 |
| 217 | M I A N T Y L L I | 1 | 4040 |
| 223 | L L I S P L M N P | 1 | 4041 |
| 232 | V I Y S V K T K Q | 1 | 4042 |
| 240 | Q I R R A V I K I | 1 | 4043 |

TABLE XIXA, PART 1-continued

| Pos | 1 2 3 4 5 6 7 8 9 | score | SEQ ID |
|---|---|---|---|
| 243 | R A V I K I L H S | 1 | 4044 |
| 244 | A V I K I L H S K | 1 | 4045 |
| HLA-B*2705 9-mers v.1: 238P1B2 | | | |
| 134 | T R I N S A V G L | 25 | 4046 |
| 241 | I R R A V I K I L | 25 | 4047 |
| 242 | R R A V I K I L H | 25 | 4048 |
| 204 | H R F G K Q A P A | 19 | 4049 |
| 32 | R E I S F N A C L | 18 | 4050 |
| 64 | R F V A V S N P L | 18 | 4051 |
| 93 | R G L L M L T P M | 18 | 4052 |
| 220 | N T Y L L I S P L | 18 | 4053 |
| 244 | A V I K I L H S K | 18 | 4054 |
| 12 | D L G L S I S T L | 17 | 4055 |
| 63 | D R F V A V S N P | 17 | 4056 |
| 72 | L R Y A M I L T D | 17 | 4057 |
| 87 | G V A S V I R G L | 17 | 4058 |
| 150 | G V D L L L I L L | 17 | 4059 |
| 154 | L L I L L S Y V L | 17 | 4060 |
| 192 | I Y Y I P L I S L | 17 | 4061 |
| 198 | I S L S I V H R F | 17 | 4062 |
| 81 | S R I A Q I G V A | 16 | 4063 |
| 90 | S V I R G L L M L | 16 | 4064 |
| 100 | P M V A L L I R L | 16 | 4065 |
| 147 | S T V G V D L L L | 16 | 4066 |
| 160 | Y V L I I R T V L | 16 | 4067 |
| 197 | L I S L S I V H R | 16 | 4068 |
| 205 | R F G K Q A P A Y | 16 | 4069 |
| 235 | S V K T K Q I R R | 16 | 4070 |
| 239 | K Q I R R A V I K | 16 | 4071 |
| 5 | L S M L S A T D L | 15 | 4072 |
| 21 | V T M L S I F W F | 15 | 4073 |
| 44 | F F I K F F T V M | 15 | 4074 |
| 49 | F T V M E S S V L | 15 | 4075 |
| 54 | S S V L L A M A F | 15 | 4076 |
| 84 | A Q I G V A S V I | 15 | 4077 |
| 92 | I R G L L M L T P | 15 | 4078 |
| 120 | Y C Y H P D V M K | 15 | 4079 |
| 121 | C Y R P D V M K L | 15 | 4080 |

TABLE XIXA, PART 1-continued

| Pos | 1 2 3 4 5 6 7 8 9 | score | SEQ ID |
|---|---|---|---|
| 138 | S A V G L T A M F | 15 | 4081 |
| 152 | D L L L I L L S Y | 15 | 4082 |
| 182 | T C V S H I V A F | 15 | 4083 |
| 207 | G K Q A P A Y V H | 15 | 4084 |
| 231 | P V I Y S V K T K | 15 | 4085 |
| 16 | S I S T L V T M L | 14 | 4086 |
| 24 | L S I F W F N V R | 14 | 4087 |
| 34 | I S F N A C L S H | 14 | 4088 |
| 50 | T V M E S S V L L | 14 | 4089 |
| 70 | N P L R Y A M I L | 14 | 4090 |
| 75 | A M I L T D S R I | 14 | 4091 |
| 96 | L M L T P M V A L | 14 | 4092 |
| 102 | V A L L I R L S Y | 14 | 4093 |
| 106 | I R L S Y C H S Q | 14 | 4094 |
| 108 | L S Y C H S Q V L | 14 | 4095 |
| 149 | V G V D L L L I L | 14 | 4096 |
| 164 | I R T V L S V A S | 14 | 4097 |
| 196 | P L I S L S I V H | 14 | 4098 |
| 221 | T Y L L I S P L M | 14 | 4099 |
| 234 | Y S V K T K Q I R | 14 | 4100 |
| 15 | L S I S T L V T M | 13 | 4101 |
| 19 | T L V T M L S I F | 13 | 4102 |
| 37 | N A C L S H M F F | 13 | 4103 |
| 40 | L S H M F F I K F | 13 | 4104 |
| 41 | S H M F F I K F F | 13 | 4105 |
| 56 | V L L A M A F D R | 13 | 4106 |
| 65 | F V A V S N P L R | 13 | 4107 |
| 97 | M L T P M V A L L | 13 | 4108 |
| 104 | L L I R L S Y C H | 13 | 4109 |
| 127 | M K L S C T D T R | 13 | 4110 |
| 128 | K L S C T D T R I | 13 | 4111 |
| 137 | N S A V G L T A M | 13 | 4112 |
| 146 | F S T V G V D L L | 13 | 4113 |
| 157 | L L S Y V L I I R | 13 | 4114 |
| 168 | L S V A S P E E R | 13 | 4115 |
| 169 | S V A S P E E R K | 13 | 4116 |
| 172 | S P E E R K E T F | 13 | 4117 |
| 175 | E R K E T F S T C | 13 | 4118 |
| 178 | E T F S T C V S H | 13 | 4119 |
| 215 | H T M I A N T Y L | 13 | 4120 |
| 216 | T M I A N T Y L L | 13 | 4121 |
| 229 | M N P V I Y S V K | 13 | 4122 |
| 7 | M L S A T D L G L | 12 | 4123 |
| 28 | W F N V R E I S F | 12 | 4124 |
| 31 | V R E I S F N A C | 12 | 4125 |
| 36 | F N A C L S H M F | 12 | 4126 |
| 57 | L L A M A F D R F | 12 | 4127 |
| 66 | V A V S N P L R Y | 12 | 4128 |
| 74 | Y A M I L T D S R | 12 | 4129 |
| 85 | Q I G V A S V I R | 12 | 4130 |
| 99 | T P M V A L L I R | 12 | 4131 |
| 109 | S Y C H S Q V L H | 12 | 4132 |
| 114 | Q V L H H S Y C Y | 12 | 4133 |
| 145 | M F S T V G V D L | 12 | 4134 |
| 189 | A F A I Y Y I P L | 12 | 4135 |
| 190 | F A I Y Y I P L I | 12 | 4136 |
| 200 | L S I V H R F G K | 12 | 4137 |
| 214 | V H T M I A N T Y | 12 | 4138 |
| 52 | M E S S V L L A M | 11 | 4139 |
| 68 | V S N P L R Y A M | 11 | 4140 |
| 78 | L T D S R I A Q I | 11 | 4141 |
| 88 | V A S V I R G L L | 11 | 4142 |
| 89 | A S V I R G L L M | 11 | 4143 |
| 155 | L I L L S Y V L I | 11 | 4144 |
| 156 | I L L S Y V L I I | 11 | 4145 |
| 185 | S H I V A F A I Y | 11 | 4146 |
| 186 | H I V A F A I Y Y | 11 | 4147 |
| 187 | I V A F A I Y Y I | 11 | 4148 |
| 194 | Y I P L I S L S I | 11 | 4149 |
| 225 | I S P L M N P V I | 11 | 4150 |
| 226 | S P L M N P V I Y | 11 | 4151 |
| 18 | S T L V T M L S I | 10 | 4152 |
| 35 | S F N A C L S H M | 10 | 4153 |
| 39 | C L S H M F F I K | 10 | 4154 |
| 110 | Y C H S Q V L H H | 10 | 4155 |
| 112 | H S Q V L H H S Y | 10 | 4156 |
| 165 | R T V L S V A S P | 10 | 4157 |

TABLE XIXA, PART 1-continued

| Pos | 1 2 3 4 5 6 7 8 9 | score | SEQ ID |
|---|---|---|---|
| 209 | Q A P A Y V H T M | 10 | 4158 |
| 210 | A P A Y V H T M I | 10 | 4159 |
| 240 | Q I R R A V I K I | 10 | 4160 |
| 243 | R A V I K I L H S | 10 | 4161 |
| 9 | S A T D L G L S I | 9 | 4162 |
| 26 | I F W F N V R E I | 9 | 4163 |
| 38 | A C L S H M F F I | 9 | 4164 |
| 98 | L T P M V A L L I | 9 | 4165 |
| 115 | V L H H S Y C Y H | 9 | 4166 |
| 119 | S Y C Y H P D V M | 9 | 4167 |
| 158 | L S Y V L I I R T | 9 | 4168 |
| 233 | I Y S V K T K Q I | 9 | 4169 |
| 11 | T D L G L S I S T | 8 | 4170 |
| 69 | S N P L R Y A M I | 8 | 4171 |
| 73 | R Y A M I L T D S | 8 | 4172 |
| 82 | R I A Q I G V A S | 8 | 4173 |
| 148 | T V G V D L L L I | 8 | 4174 |
| 151 | V D L L L I L L S | 8 | 4175 |
| 179 | T F S T C V S H I | 8 | 4176 |
| 184 | V S H I V A F A I | 8 | 4177 |
| 193 | Y Y I P L I S L S | 8 | 4178 |
| 232 | V I Y S V K T K Q | 8 | 4179 |
| 238 | T K Q I R R A V I | 8 | 4180 |
| 2 | Y Y F L S M L S A | 7 | 4181 |
| 25 | S I F W F N V R E | 7 | 4182 |
| 46 | I K F F T V M E S | 7 | 4183 |
| 47 | K F F T V M E S S | 7 | 4184 |
| 86 | I G V A S V I R G | 7 | 4185 |
| 94 | G L L M L T P M V | 7 | 4186 |
| 159 | S Y V L I I R T V | 7 | 4187 |
| 176 | R K E T F S T C V | 7 | 4188 |
| 217 | M I A N T Y L L I | 7 | 4189 |
| 223 | L L I S P L M N P | 7 | 4190 |
| 228 | L M N P V I Y S V | 7 | 4191 |
| 236 | V K T K Q I R R A | 7 | 4192 |
| 10 | A T D L G L S I S | 6 | 4193 |
| 13 | L G L S I S T L V | 6 | 4194 |
| 14 | G L S I S T L V T | 6 | 4195 |
| 29 | F N V R E I S F N | 6 | 4196 |
| 83 | I A Q I G V A S V | 6 | 4197 |
| 107 | R L S Y C H S Q V | 6 | 4198 |
| 144 | A M F S T V G V D | 6 | 4199 |
| 195 | I P L I S L S I V | 6 | 4200 |
| 213 | Y V H T M I A N T | 6 | 4201 |
| 246 | I K I L H S K E T | 6 | 4202 |
| 1 | M Y Y F L S M L S | 5 | 4203 |
| 30 | N V R E I S F N A | 5 | 4204 |
| 42 | H M F F I K F F T | 5 | 4205 |
| 43 | M F F I K F F T V | 5 | 4206 |
| 91 | V I R G L L M L T | 5 | 4207 |
| 101 | M V A L L I R L S | 5 | 4208 |
| 103 | A L L I R L S Y C | 5 | 4209 |
| 125 | D V M K L S C T D | 5 | 4210 |
| 131 | C T D T R I N S A | 5 | 4211 |
| 135 | R I N S A V G L T | 5 | 4212 |
| 141 | G L T A M F S T V | 5 | 4213 |
| 153 | L L L I L L S Y V | 5 | 4214 |
| 162 | L I I R T V L S V | 5 | 4215 |
| 163 | I I R T V L S V A | 5 | 4216 |
| 166 | T V L S V A S P E | 5 | 4217 |
| 188 | V A F A I Y Y I P | 5 | 4218 |
| 191 | A I Y Y I P L I S | 5 | 4219 |
| 219 | A N T Y L L I S P | 5 | 4220 |
| 230 | N P V I Y S V K T | 5 | 4221 |
| 237 | K T K Q I R R A V | 5 | 4222 |
| 3 | Y F L S M L S A T | 4 | 4223 |
| 4 | F L S M L S A T D | 4 | 4224 |
| 17 | I S T L V T M L S | 4 | 4225 |
| 22 | T M L S I F W F N | 4 | 4226 |
| 27 | F W F N V R E I S | 4 | 4227 |
| 55 | S V L L A M A F D | 4 | 4228 |
| 60 | M A F D R F V A V | 4 | 4229 |
| 61 | A F D R F V A V S | 4 | 4230 |
| 62 | F D R F V A V S N | 4 | 4231 |
| 111 | C H S Q V L H H S | 4 | 4232 |
| 124 | P D V M K L S C T | 4 | 4233 |
| 126 | V M K L S C T D T | 4 | 4234 |

TABLE XIXA, PART 1-continued

| Pos | 1 2 3 4 5 6 7 8 9 | score | SEQ ID |
|---|---|---|---|
| 136 | I N S A V G L T A | 4 | 4235 |
| 139 | A V G L T A M F S | 4 | 4236 |
| 142 | L T A M F S T V G | 4 | 4237 |
| 170 | V A S P E E R K E | 4 | 4238 |
| 171 | A S P E E R K E T | 4 | 4239 |
| 174 | E E R K E T F S T | 4 | 4240 |
| 177 | K E T F S T C V S | 4 | 4241 |
| 208 | K Q A P A Y V H T | 4 | 4242 |
| 222 | Y L L I S P L M N | 4 | 4243 |
| 245 | V I K I L H S K E | 4 | 4244 |
| 20 | L V T M L S I F W | 3 | 4245 |
| 51 | V M E S S V L L A | 3 | 4246 |
| 53 | E S S V L L A M A | 3 | 4247 |
| 67 | A V S N P L R Y A | 3 | 4248 |
| 76 | M I L T D S R I A | 3 | 4249 |
| 77 | I L T D S R I A Q | 3 | 4250 |
| 80 | D S R I A Q I G V | 3 | 4251 |
| 95 | L L M L T P M V A | 3 | 4252 |
| 113 | S Q V L H H S Y C | 3 | 4253 |
| 118 | H S Y C Y H P D V | 3 | 4254 |
| 123 | H P D V M K L S C | 3 | 4255 |
| 130 | S C T D T R I N S | 3 | 4256 |
| 132 | T D T R I N S A V | 3 | 4257 |
| 133 | D T R I N S A V G | 3 | 4258 |
| 140 | V G L T A M F S T | 3 | 4259 |
| 161 | V L I I R T V L S | 3 | 4260 |
| 167 | V L S V A S P E E | 3 | 4261 |
| 173 | P E E R K E T F S | 3 | 4262 |
| 181 | S T C V S H I V A | 3 | 4263 |
| 183 | C V S H I V A F A | 3 | 4264 |
| 201 | S I V H R F G K Q | 3 | 4265 |
| 203 | V H R F G K Q A P | 3 | 4266 |
| 206 | F G K Q A P A Y V | 3 | 4267 |
| 211 | P A Y V H T M I A | 3 | 4268 |
| 212 | A Y V H T M I A N | 3 | 4269 |
| 218 | I A N T Y L L I S | 3 | 4270 |
| 224 | L I S P L M N P V | 3 | 4271 |
| 227 | P L M N P V I Y S | 3 | 4272 |
| 6 | S M L S A T D L G | 2 | 4273 |

TABLE XIXA, PART 1-continued

| Pos | 1 2 3 4 5 6 7 8 9 | score | SEQ ID |
|---|---|---|---|
| 23 | M L S I F W F N V | 2 | 4274 |
| 48 | F F T V M E S S V | 2 | 4275 |
| 59 | A M A F D R F V A | 2 | 4276 |
| 79 | T D S R I A Q I G | 2 | 4277 |
| 105 | L I R L S Y C H S | 2 | 4278 |
| 143 | T A M F S T V G V | 2 | 4279 |
| 180 | F S T C V S H I V | 2 | 4280 |
| 202 | I V H R F G K Q A | 2 | 4281 |
| 8 | L S A T D L G L S | 1 | 4282 |
| 33 | E I S F N A C L S | 1 | 4283 |
| 45 | E I K E F T V M E | 1 | 4284 |
| 58 | L A M A F D R F V | 1 | 4285 |
| 71 | P L R Y A M I L T | 1 | 4286 |
| 116 | L H H S Y C Y H P | 1 | 4287 |
| 122 | Y H P D V M K L S | 1 | 4288 |
| 199 | S L S I V H R F G | 1 | 4289 |
| HLA-B*2709 9-mers v.1: 238P1B2 | | | |
| 134 | T R I N S A V G L | 23 | 4290 |
| 241 | I R R A V I K I L | 21 | 4291 |
| 32 | R E I S F N A C L | 16 | 4292 |
| 64 | R F V A V S N P L | 15 | 4293 |
| 198 | I S L S I V H R F | 15 | 4294 |
| 242 | R R A V I K I L H | 15 | 4295 |
| 63 | D R F V A V S N P | 14 | 4296 |
| 87 | G V A S V I R G L | 14 | 4297 |
| 93 | R G L L M L T P M | 14 | 4298 |
| 94 | G L L M L T P M V | 14 | 4299 |
| 106 | I R L S Y C H S Q | 14 | 4300 |
| 156 | I L L S Y V L I I | 14 | 4301 |
| 70 | N P L R Y A M I L | 13 | 4302 |
| 72 | L R Y A M I L T D | 13 | 4303 |
| 96 | L M L T P M V A L | 13 | 4304 |
| 97 | M L T P M V A L L | 13 | 4305 |
| 107 | R L S Y C H S Q V | 13 | 4306 |
| 121 | C Y H P D V M K L | 13 | 4307 |
| 150 | G V D L L L I L L | 13 | 4308 |
| 160 | Y V L I I R T V L | 13 | 4309 |
| 164 | I R T V L S V A S | 13 | 4310 |

TABLE XIXA, PART 1-continued

| Pos | 1 2 3 4 5 6 7 8 9 | score | SEQ ID |
|---|---|---|---|
| 192 | I Y Y I P L I S L | 13 | 4311 |
| 13 | L G L S I S T L V | 12 | 4312 |
| 38 | A C L S H M F F I | 12 | 4313 |
| 90 | S V I R G L L M L | 12 | 4314 |
| 92 | I R G L L M L T P | 12 | 4315 |
| 100 | P M V A L L I R L | 12 | 4316 |
| 108 | L S Y C H S Q V L | 12 | 4317 |
| 141 | G L T A M F S T V | 12 | 4318 |
| 146 | F S T V G V D L L | 12 | 4319 |
| 147 | S T V G V D L L L | 12 | 4320 |
| 149 | V G V D L L L I L | 12 | 4321 |
| 154 | L L I L L S Y V L | 12 | 4322 |
| 176 | R K E T F S T C V | 12 | 4323 |
| 204 | H R F G K Q A P A | 12 | 4324 |
| 216 | T M I A N T Y L L | 12 | 4325 |
| 220 | N T Y L L I S P L | 12 | 4326 |
| 221 | T Y L L I S P L M | 12 | 4327 |
| 5 | L S M L S A T D L | 11 | 4328 |
| 7 | M L S A T D L G L | 11 | 4329 |
| 15 | L S I S T L V T M | 11 | 4330 |
| 16 | S I S T L V T M L | 11 | 4331 |
| 18 | S T L V T M L S I | 11 | 4332 |
| 49 | F T V M E S S V L | 11 | 4333 |
| 50 | T V M E S S V L L | 11 | 4334 |
| 60 | M A F D R F V A V | 11 | 4335 |
| 75 | A M I L T D S R I | 11 | 4336 |
| 81 | S R I A Q I G V A | 11 | 4337 |
| 84 | A Q I G V A S V I | 11 | 4338 |
| 88 | V A S V I R G L L | 11 | 4339 |
| 89 | A S V I R G L L M | 11 | 4340 |
| 118 | H S Y C Y H P D V | 11 | 4341 |
| 128 | K L S C T D T R I | 11 | 4342 |
| 145 | M F S T V G V D L | 11 | 4343 |
| 155 | L I L L S Y V L I | 11 | 4344 |
| 162 | L I I R T V L S V | 11 | 4345 |
| 182 | T C V S H I V A F | 11 | 4346 |
| 189 | A F A I Y Y I P L | 11 | 4347 |
| 195 | I P L I S L S I V | 11 | 4348 |
| 237 | K T K Q I R R A V | 11 | 4349 |
| 9 | S A T D L G L S I | 10 | 4350 |
| 12 | D L G L S I S T L | 10 | 4351 |
| 26 | I F W F N V R E I | 10 | 4352 |
| 31 | V R E I S F N A C | 10 | 4353 |
| 43 | M F F I K F F T V | 10 | 4354 |
| 52 | M E S S V L L A M | 10 | 4355 |
| 54 | S S V L L A M A F | 10 | 4356 |
| 68 | V S N P L R Y A M | 10 | 4357 |
| 78 | L T D S R I A Q I | 10 | 4358 |
| 83 | I A Q I G V A S V | 10 | 4359 |
| 98 | L T P M V A L L I | 10 | 4360 |
| 132 | T D T R I N S A V | 10 | 4361 |
| 148 | T V G V D L L L I | 10 | 4362 |
| 153 | L L L I L L S Y V | 10 | 4363 |
| 159 | S Y V L I I R T V | 10 | 4364 |
| 175 | E R K E T F S T C | 10 | 4365 |
| 187 | I V A F A I Y Y I | 10 | 4366 |
| 190 | F A I Y Y I P L I | 10 | 4367 |
| 194 | Y I P L I S L S I | 10 | 4368 |
| 215 | H T M I A N T Y L | 10 | 4369 |
| 225 | I S P L M N P V I | 10 | 4370 |
| 228 | L M N P V I Y S V | 10 | 4371 |
| 233 | I Y S V K T K Q I | 10 | 4372 |
| 19 | T L V T M L S I F | 9 | 4373 |
| 23 | M L S I F W F N V | 9 | 4374 |
| 44 | F F I K F F T V M | 9 | 4375 |
| 48 | F F T V M E S S V | 9 | 4376 |
| 57 | L L A M A F D R F | 9 | 4377 |
| 138 | S A V G L T A M F | 9 | 4378 |
| 143 | T A M F S T V G V | 9 | 4379 |
| 179 | T F S T C V S H I | 9 | 4380 |
| 180 | F S T C V S H I V | 9 | 4381 |
| 184 | V S H I V A F A I | 9 | 4382 |
| 209 | Q A P A Y V H T M | 9 | 4383 |
| 210 | A P A Y V H T M I | 9 | 4384 |
| 217 | M I A N T Y L L I | 9 | 4385 |
| 224 | L I S P L M N P V | 9 | 4386 |
| 240 | Q I R R A V I K I | 9 | 4387 |

TABLE XIXA, PART 1-continued

| Pos | 1 2 3 4 5 6 7 8 9 | score | SEQ ID |
|---|---|---|---|
| 21 | V T M L S I F W F | 8 | 4388 |
| 28 | W F N V R E I S F | 8 | 4389 |
| 35 | S F N A C L S H M | 8 | 4390 |
| 36 | F N A C L S H M F | 8 | 4391 |
| 37 | N A C L S H M F F | 8 | 4392 |
| 40 | L S H M F F I K F | 8 | 4393 |
| 41 | S H M F F I K F F | 8 | 4394 |
| 58 | L A M A F D R F V | 8 | 4395 |
| 69 | S N P L R Y A M I | 8 | 4396 |
| 80 | D S R I A Q I G V | 8 | 4397 |
| 119 | S Y C Y H P D V M | 8 | 4398 |
| 137 | N S A V G L T A M | 8 | 4399 |
| 172 | S P E E R K E T F | 8 | 4400 |
| 206 | F G K Q A P A Y V | 8 | 4401 |
| 238 | T K Q I R R A V I | 8 | 4402 |
| 82 | R I A Q I G V A S | 6 | 4403 |
| 135 | R I N S A V G L T | 6 | 4404 |
| 165 | R T V L S V A S P | 6 | 4405 |
| 205 | R F G K Q A P A Y | 6 | 4406 |
| 243 | R A V I K I L H S | 6 | 4407 |
| 73 | R Y A M I L T D S | 5 | 4408 |
| 144 | A M F S T V G V D | 5 | 4409 |
| 191 | A I Y Y I P L I S | 5 | 4410 |
| 207 | G K Q A P A Y V H | 5 | 4411 |
| 239 | K Q I R R A V I K | 5 | 4412 |
| 14 | G L S I S T L V T | 4 | 4413 |
| 22 | T M L S I F W F N | 4 | 4414 |
| 25 | S I F W F N V R E | 4 | 4415 |
| 34 | I S F N A C L S H | 4 | 4416 |
| 46 | I K F F T V M E S | 4 | 4417 |
| 47 | K F F T V M E S S | 4 | 4418 |
| 66 | V A V S N P L R Y | 4 | 4419 |
| 86 | I G V A S V I R G | 4 | 4420 |
| 102 | V A L L I R L S Y | 4 | 4421 |
| 152 | D L L I L L S Y | 4 | 4422 |
| 166 | T V L S V A S P E | 4 | 4423 |
| 178 | E T F S T G V S H | 4 | 4424 |
| 188 | V A F A T Y Y I P | 4 | 4425 |
| 208 | K Q A P A Y V H T | 4 | 4426 |

TABLE XIXA, PART 1-continued

| Pos | 1 2 3 4 5 6 7 8 9 | score | SEQ ID |
|---|---|---|---|
| 2 | Y Y F L S M L S A | 3 | 4427 |
| 3 | Y F L S M L S A T | 3 | 4428 |
| 6 | S M L S A T D L G | 3 | 4429 |
| 42 | H M F F I K F F T | 3 | 4430 |
| 51 | V M E S S V L L A | 3 | 4431 |
| 56 | V L L A M A F D R | 3 | 4432 |
| 76 | M I L T D S R I A | 3 | 4433 |
| 103 | A L L I R L S Y C | 3 | 4434 |
| 110 | Y C H S Q V L H H | 3 | 4435 |
| 114 | Q V L H H S Y C Y | 3 | 4436 |
| 120 | Y C Y H P D V M K | 3 | 4437 |
| 127 | M K L S C T D T R | 3 | 4438 |
| 151 | V D L L L I L L S | 3 | 4439 |
| 158 | L S Y V L I I R T | 3 | 4440 |
| 177 | K E T F S T C V S | 3 | 4441 |
| 214 | V H T M I A N T Y | 3 | 4442 |
| 222 | Y L L I S P L M N | 3 | 4443 |
| 223 | L L I S P L M N P | 3 | 4444 |
| 226 | S P L M N P V I Y | 3 | 4445 |
| 232 | V I Y S V K T K Q | 3 | 4446 |
| 244 | A V I K I L H S K | 3 | 4447 |
| 1 | M Y Y F L S M L S | 2 | 4448 |
| 11 | T D L G L S I S T | 2 | 4449 |
| 17 | I S T L V T M L S | 2 | 4450 |
| 27 | F W F N V R E I S | 2 | 4451 |
| 30 | N V R E I S F N A | 2 | 4452 |
| 55 | S V L L A M A F D | 2 | 4453 |
| 59 | A M A F D R F V A | 2 | 4454 |
| 61 | A F D R F V A V S | 2 | 4455 |
| 62 | F D R F V A V S N | 2 | 4456 |
| 77 | I L T D S R I A Q | 2 | 4457 |
| 79 | T D S R I A Q I G | 2 | 4458 |
| 104 | L L I R L S Y C H | 2 | 4459 |
| 116 | L H H S Y C Y H P | 2 | 4460 |
| 130 | S C T D T R I N S | 2 | 4461 |
| 136 | I N S A V G L T A | 2 | 4462 |
| 139 | A V G L T A M F S | 2 | 4463 |
| 140 | V G L T A M F S T | 2 | 4464 |

TABLE XIXA, PART 1-continued

| Pos | 1 2 3 4 5 6 7 8 9 | score | SEQ ID |
|---|---|---|---|
| 161 | V L I I R T V L S | 2 | 4465 |
| 169 | S V A S P E E R K | 2 | 4466 |
| 183 | C V S H I V A F A | 2 | 4467 |
| 186 | H I V A F A I Y Y | 2 | 4468 |
| 193 | Y Y I P L I S L S | 2 | 4469 |
| 196 | P L I S L S I V H | 2 | 4470 |
| 202 | I V H R F G K Q A | 2 | 4471 |
| 211 | P A Y V H T M I A | 2 | 4472 |
| 212 | A Y V H T M I A N | 2 | 4473 |
| 218 | I A N T Y L L I S | 2 | 4474 |
| 219 | A N T Y L L I S P | 2 | 4475 |
| 230 | N P V I Y S V K T | 2 | 4476 |
| 231 | P V I Y S V K T K | 2 | 4477 |
| 236 | V K T Q I R R A | 2 | 4478 |
| 246 | I K I L H S K E T | 2 | 4479 |
| 8 | L S A T D L G L S | 1 | 4480 |
| 10 | A T D L G L S I S | 1 | 4481 |
| 20 | L V T M L S I F W | 1 | 4482 |
| 24 | L S I F W F N V R | 1 | 4483 |
| 29 | F N V R E I S F N | 1 | 4484 |
| 33 | E I S F N A C L S | 1 | 4485 |
| 45 | F I K F F T V M E | 1 | 4486 |
| 65 | F V A V S N P L R | 1 | 4487 |
| 67 | A V S N P L R Y A | 1 | 4488 |
| 85 | Q I G V A S V I R | 1 | 4489 |
| 99 | T P M V A L L I R | 1 | 4490 |
| 109 | S Y C H S Q V L H | 1 | 4491 |
| 113 | S Q V L H H S Y C | 1 | 4492 |
| 123 | H P D V M K L S C | 1 | 4493 |
| 124 | P D V M K L S C T | 1 | 4494 |
| 129 | L S C T D T R I N | 1 | 4495 |
| 163 | I I R T V L S V A | 1 | 4496 |
| 167 | V L S V A S P E E | 1 | 4497 |
| 168 | L S V A S P E E R | 1 | 4498 |
| 170 | V A S P E E R K E | 1 | 4499 |
| 171 | A S P E E R K E T | 1 | 4500 |
| 185 | S H I V A F A I Y | 1 | 4501 |
| 197 | L I S L S I V H R | 1 | 4502 |
| 200 | L S I V H R F G K | 1 | 4503 |
| 201 | S I V H R F G K Q | 1 | 4504 |
| 213 | Y V H T M I A N T | 1 | 4505 |
| 227 | P L M N P V I Y S | 1 | 4506 |
| 229 | M N P V I Y S V K | 1 | 4507 |
| 234 | Y S V K T K Q I R | 1 | 4508 |
| 235 | S V K T K Q I R R | 1 | 4509 |

HLA-B*4402 9-mers v.1: 238P1B2

| Pos | 1 2 3 4 5 6 7 8 9 | score | SEQ ID |
|---|---|---|---|
| 32 | R E I S F N A C L | 23 | 4510 |
| 41 | S H M F F I K F F | 17 | 4511 |
| 84 | A Q I G V A S V I | 17 | 4512 |
| 90 | S V I R G L L M L | 17 | 4513 |
| 134 | T R I N S A V G L | 16 | 4514 |
| 182 | T C V S H I V A F | 16 | 4515 |
| 216 | T M I A N T Y L L | 16 | 4516 |
| 12 | D L G L S I S T L | 15 | 4517 |
| 21 | V T M L S I F W F | 15 | 4518 |
| 52 | M E S S V L L A M | 15 | 4519 |
| 54 | S S V L L A M A F | 15 | 4520 |
| 75 | A M I L T D S R I | 15 | 4521 |
| 96 | L M L T P M V A L | 15 | 4522 |
| 97 | M L T P M V A L L | 15 | 4523 |
| 102 | V A L L I R L S Y | 15 | 4524 |
| 121 | C Y H P D V M K L | 15 | 4525 |
| 150 | G V D L L L I L L | 15 | 4526 |
| 152 | D L L L I L L S Y | 15 | 4527 |
| 154 | L L I L L S Y V L | 15 | 4528 |
| 185 | S H I V A F A I Y | 15 | 4529 |
| 190 | F A I Y Y I P L I | 15 | 4530 |
| 220 | N T Y L L I S P L | 15 | 4531 |
| 226 | S P L M N P V I Y | 15 | 4532 |
| 241 | I R R A V I K I L | 15 | 4533 |
| 16 | S I S T L V T M L | 14 | 4534 |
| 70 | N P L R Y A M I L | 14 | 4535 |
| 78 | L T D S R I A Q I | 14 | 4536 |
| 87 | G V A S V I R G L | 14 | 4537 |
| 88 | V A S V I R G L L | 14 | 4538 |
| 147 | S T V G V D L L L | 14 | 4539 |
| 160 | Y V L I I R T V L | 14 | 4540 |

TABLE XIXA, PART 1-continued

| Pos | 1 2 3 4 5 6 7 8 9 | score | SEQ ID |
|---|---|---|---|
| 189 | A F A I Y Y I P L | 14 | 4541 |
| 198 | I S L S I V H R F | 14 | 4542 |
| 214 | V H T M I A N T Y | 14 | 4543 |
| 5 | L S M L S A T D L | 13 | 4544 |
| 40 | L S H M F F I K F | 13 | 4545 |
| 50 | T V M E S S V L L | 13 | 4546 |
| 66 | V A V S N P L R Y | 13 | 4547 |
| 138 | S A V G L T A M F | 13 | 4548 |
| 145 | M F S T V G V D L | 13 | 4549 |
| 149 | V G V D L L L I L | 13 | 4550 |
| 172 | S P E E R K E T F | 13 | 4551 |
| 174 | E E R K E T F S T | 13 | 4552 |
| 177 | K E T F S T C V S | 13 | 4553 |
| 205 | R F G K Q A P A Y | 13 | 4554 |
| 233 | I Y S V K T K Q I | 13 | 4555 |
| 7 | M L S A T D L G L | 12 | 4556 |
| 19 | T L V T M L S I F | 12 | 4557 |
| 28 | W F N V R E I S F | 12 | 4558 |
| 37 | N A C L S H M F F | 12 | 4559 |
| 38 | A C L S H M F F I | 12 | 4560 |
| 69 | S N P L R Y A M I | 12 | 4561 |
| 98 | L T P M V A L L I | 12 | 4562 |
| 100 | P M V A L L I R L | 12 | 4563 |
| 146 | F S T V G V D L L | 12 | 4564 |
| 155 | L I L L S Y V L I | 12 | 4565 |
| 186 | H I V A F A I Y Y | 12 | 4566 |
| 192 | I Y Y I P L I S L | 12 | 4567 |
| 194 | Y I P L I S L S I | 12 | 4568 |
| 240 | Q I R R A V I K I | 12 | 4569 |
| 9 | S A T D L G L S I | 11 | 4570 |
| 18 | S T L V T M L S I | 11 | 4571 |
| 20 | L V T M L S I F W | 11 | 4572 |
| 26 | I F W F N V R E I | 11 | 4573 |
| 36 | F N A C L S H M F | 11 | 4574 |
| 49 | F T V M E S S V L | 11 | 4575 |
| 57 | L L A M A F D R F | 11 | 4576 |
| 64 | R F V A V S N P L | 11 | 4577 |
| 108 | L S Y C H S Q V L | 11 | 4578 |
| 112 | H S Q V L H H S Y | 11 | 4579 |
| 114 | Q V L H H S Y C Y | 11 | 4580 |
| 148 | T V G V D L L L I | 11 | 4581 |
| 156 | I L L S Y V L I I | 11 | 4582 |
| 173 | P E E R K E T F S | 11 | 4583 |
| 179 | T F S T C V S H I | 11 | 4584 |
| 184 | V S H I V A F A I | 11 | 4585 |
| 187 | I V A F A I Y Y I | 11 | 4586 |
| 210 | A P A Y V H T M I | 11 | 4587 |
| 215 | H T M I A N T Y L | 11 | 4588 |
| 217 | M I A N T Y L L I | 11 | 4589 |
| 225 | I S P L M N P V I | 11 | 4590 |
| 238 | T K Q I R R A V I | 11 | 4591 |
| 128 | K L S C T D T R I | 10 | 4592 |
| 193 | Y Y I P L I S L S | 10 | 4593 |
| 244 | A V I K I L H S K | 9 | 4594 |
| 60 | M A F D R F V A V | 8 | 4595 |
| 81 | S R I A Q I G V A | 8 | 4596 |
| 159 | S Y V L I I R T V | 8 | 4597 |
| 239 | K Q I R R A V I K | 8 | 4598 |
| 61 | A F D R F V A V S | 7 | 4599 |
| 67 | A V S N P L R Y A | 7 | 4600 |
| 131 | C T D T R I N S A | 7 | 4601 |
| 144 | A M F S T V G V D | 7 | 4602 |
| 151 | V D L L L I L L S | 7 | 4603 |
| 161 | V L I I R T V L S | 7 | 4604 |
| 171 | A S P E E R K E T | 7 | 4605 |
| 231 | P V I Y S V K T K | 7 | 4606 |
| 10 | A T D L G L S I S | 6 | 4607 |
| 15 | L S I S T L V T M | 6 | 4608 |
| 24 | L S I F W F N V R | 6 | 4609 |
| 33 | E I S F N A C L S | 6 | 4610 |
| 68 | V S N P L R Y A M | 6 | 4611 |
| 89 | A S V I R G L L M | 6 | 4612 |
| 101 | M V A L L I R L S | 6 | 4613 |
| 103 | A L L I R L S Y C | 6 | 4614 |
| 162 | L I I R T V L S V | 6 | 4615 |
| 170 | V A S P E E R K E | 6 | 4616 |
| 191 | A I Y Y I P L I S | 6 | 4617 |

TABLE XIXA, PART 1-continued

| Pos | 1 2 3 4 5 6 7 8 9 | score | SEQ ID |
|---|---|---|---|
| 197 | L I S L S I V H R | 6 | 4618 |
| 212 | A Y V H T M I A N | 6 | 4619 |
| 228 | L M N P V I Y S V | 6 | 4620 |
| 237 | K T K Q I R R A V | 6 | 4621 |
| 246 | I K I L H S K E T | 6 | 4622 |
| 44 | F F I K F F T V M | 5 | 4623 |
| 59 | A M A F D R F V A | 5 | 4624 |
| 72 | L R Y A M I L T D | 5 | 4625 |
| 77 | I L T D S R I A Q | 5 | 4626 |
| 122 | Y H P D V M K L S | 5 | 4627 |
| 139 | A V G L T A M F S | 5 | 4628 |
| 178 | E T F S T C V S H | 5 | 4629 |
| 196 | P L I S L S I V H | 5 | 4630 |
| 208 | K Q A P A Y V H T | 5 | 4631 |
| 219 | A N T Y L L I S P | 5 | 4632 |
| 224 | L I S P L M N P V | 5 | 4633 |
| 2 | Y Y F L S M L S A | 4 | 4634 |
| 3 | Y F L S M L S A T | 4 | 4635 |
| 6 | S M L S A T D L G | 4 | 4636 |
| 14 | G L S I S T L V T | 4 | 4637 |
| 25 | S I F W F N V R E | 4 | 4638 |
| 27 | F W F N V R E I S | 4 | 4639 |
| 29 | F N V R E I S F N | 4 | 4640 |
| 31 | V R E I S F N A C | 4 | 4641 |
| 34 | I S F N A C L S H | 4 | 4642 |
| 43 | M F F I K F F T V | 4 | 4643 |
| 47 | K F F T V M E S S | 4 | 4644 |
| 53 | E S S V L L A M A | 4 | 4645 |
| 79 | T D S R I A Q I G | 4 | 4646 |
| 82 | R I A Q I G V A S | 4 | 4647 |
| 95 | L L M L T P M V A | 4 | 4648 |
| 104 | L L I R L S Y C H | 4 | 4649 |
| 130 | S C T D T R I N S | 4 | 4650 |
| 132 | T D T R I N S A V | 4 | 4651 |
| 137 | N S A V G L T A M | 4 | 4652 |
| 158 | L S Y V L I I R T | 4 | 4653 |
| 175 | E R K E T F S T C | 4 | 4654 |
| 200 | L S I V H R F G K | 4 | 4655 |
| 201 | S I V H R F G K Q | 4 | 4656 |
| 202 | T V H R F G K Q A | 4 | 4657 |
| 209 | Q A P A Y V H T M | 4 | 4658 |
| 213 | Y V H T M I A N T | 4 | 4659 |
| 221 | T Y L L I S P L M | 4 | 4660 |
| 223 | L L I S P L M N P | 4 | 4661 |
| 227 | P L M N P V I Y S | 4 | 4662 |
| 236 | V K T K Q I R R A | 4 | 4663 |
| 243 | R A V I K I L H S | 4 | 4664 |
| 8 | L S A T D L G L S | 3 | 4665 |
| 11 | T D L G L S I S T | 3 | 4666 |
| 13 | L G L S I S T L V | 3 | 4667 |
| 17 | I S T L V T M L S | 3 | 4668 |
| 22 | T M L S I F W F N | 3 | 4669 |
| 42 | H M F F I K F F T | 3 | 4670 |
| 46 | I K F F T V M E S | 3 | 4671 |
| 51 | V M E S S V L L A | 3 | 4672 |
| 55 | S V L L A M A F D | 3 | 4673 |
| 63 | D R F V A V S N P | 3 | 4674 |
| 76 | M I L T D S R I A | 3 | 4675 |
| 91 | V I R G L L M L T | 3 | 4676 |
| 92 | I R G L L M L T P | 3 | 4677 |
| 93 | R G L L M L T P M | 3 | 4678 |
| 99 | T P M V A L L I R | 3 | 4679 |
| 109 | S Y C H S Q V L H | 3 | 4680 |
| 111 | C H S Q V L H H S | 3 | 4681 |
| 119 | S Y C Y H P D V M | 3 | 4682 |
| 127 | M K L S C T D T R | 3 | 4683 |
| 129 | L S C T D T R I N | 3 | 4684 |
| 136 | I N S A V G L T A | 3 | 4685 |
| 143 | T A M F S T V G V | 3 | 4686 |
| 157 | L L S Y V L I I R | 3 | 4687 |
| 163 | I I R T V L S V A | 3 | 4688 |
| 164 | I R T V L S V A S | 3 | 4689 |
| 181 | S T C V S H I V A | 3 | 4690 |
| 183 | C V S H I V A F A | 3 | 4691 |
| 188 | V A F A I Y Y I P | 3 | 4692 |
| 199 | S L S I V H R F G | 3 | 4693 |
| 204 | H R F G K Q A P A | 3 | 4694 |

TABLE XIXA, PART 1-continued

| Pos | 1 2 3 4 5 6 7 8 9 | score | SEQ ID |
|---|---|---|---|
| 218 | I A N T Y L L I S | 3 | 4695 |
| 222 | Y L L I S P L M N | 3 | 4696 |
| 229 | M N P V I Y S V K | 3 | 4697 |
| 230 | N P V I Y S V K T | 3 | 4698 |
| 235 | S V K T K Q I R R | 3 | 4699 |
| 242 | R R A V I K I L H | 3 | 4700 |
| 4 | F L S M L S A T D | 2 | 4701 |
| 30 | N V R E I S F N A | 2 | 4702 |
| 35 | S F N A C L S H M | 2 | 4703 |
| 39 | C L S H M F F I K | 2 | 4704 |
| 45 | F I K F F T V M E | 2 | 4705 |
| 56 | V L L A M A F D R | 2 | 4706 |
| 58 | L A M A F D R F V | 2 | 4707 |
| 62 | F D R F V A V S N | 2 | 4708 |
| 71 | P L R Y A M I L T | 2 | 4709 |
| 73 | R Y A M I L T D S | 2 | 4710 |
| 74 | Y A M I L T D S R | 2 | 4711 |
| 86 | I G V A S V I R G | 2 | 4712 |
| 94 | G L L M L T P M V | 2 | 4713 |
| 106 | I R L S Y C H S Q | 2 | 4714 |
| 107 | R L S Y C H S Q V | 2 | 4715 |
| 110 | Y C H S Q V L H H | 2 | 4716 |
| 113 | S Q V L H H S Y C | 2 | 4717 |
| 117 | H H S Y C Y H P D | 2 | 4718 |
| 123 | H P D V M K L S C | 2 | 4719 |
| 125 | D V M K L S C T D | 2 | 4720 |
| 133 | D T R I N S A V G | 2 | 4721 |
| 135 | R I N S A V G L T | 2 | 4722 |
| 140 | V G L T A M F S T | 2 | 4723 |
| 141 | G L T A M F S T V | 2 | 4724 |
| 153 | L L L I L L S Y V | 2 | 4725 |
| 165 | R T V L S V A S P | 2 | 4726 |
| 166 | T V L S V A S P E | 2 | 4727 |
| 195 | I P L I S L S I V | 2 | 4728 |
| 203 | V H R F G K Q A P | 2 | 4729 |
| 207 | G K Q A P A Y V H | 2 | 4730 |
| 1 | M Y Y F L S M L S | 1 | 4731 |
| 23 | M L S I F W F N V | 1 | 4732 |
| 65 | F V A V S N P L R | 1 | 4733 |

TABLE XIXA, PART 1-continued

| Pos | 1 2 3 4 5 6 7 8 9 | score | SEQ ID |
|---|---|---|---|
| 80 | D S R I A Q I G V | 1 | 4734 |
| 83 | I A Q I G V A S V | 1 | 4735 |
| 85 | Q I G V A S V I R | 1 | 4736 |
| 105 | L I R L S Y C H S | 1 | 4737 |
| 120 | Y C Y H P D V M K | 1 | 4738 |
| 124 | P D V M K L S C T | 1 | 4739 |
| 126 | V M K L S C T D T | 1 | 4740 |
| 142 | L T A M F S T V G | 1 | 4741 |
| 167 | V L S V A S P E E | 1 | 4742 |
| 168 | L S V A S P E E R | 1 | 4743 |
| 169 | S V A S P E E R K | 1 | 4744 |
| 176 | R K E T F S T C V | 1 | 4745 |
| 180 | F S T C V S H I V | 1 | 4746 |
| 206 | F G K Q A P A Y V | 1 | 4747 |
| 211 | P A Y V H T M I A | 1 | 4748 |
| 232 | V I Y S V K T K Q | 1 | 4749 |
| 245 | V I K T L H S K E | 1 | 4750 |
| HLA-B*5101 9-mers v.1: 238P1B2 | | | |
| 195 | I P L I S L S I V | 24 | 4751 |
| 60 | M A F D R F V A V | 23 | 4752 |
| 190 | F A I Y Y I P L I | 23 | 4753 |
| 210 | A P A Y V H T M I | 23 | 4754 |
| 9 | S A T D L G L S I | 22 | 4755 |
| 58 | L A M A F D R F V | 22 | 4756 |
| 83 | T A Q I G V A S V | 22 | 4757 |
| 70 | N P L R Y A M I L | 21 | 4758 |
| 143 | T A M F S T V G V | 21 | 4759 |
| 13 | L G L S I S T L V | 19 | 4760 |
| 156 | I L L S Y V L I I | 18 | 4761 |
| 225 | I S P L M N P V I | 18 | 4762 |
| 84 | A Q I G V A S V I | 17 | 4763 |
| 88 | V A S V I R G L L | 17 | 4764 |
| 98 | L T P M V A L L I | 17 | 4765 |
| 209 | Q A P A Y V H T M | 17 | 4766 |
| 26 | I F W F N V R E I | 16 | 4767 |
| 149 | V G V D L L L I L | 16 | 4768 |
| 155 | L I L L S Y V L I | 16 | 4769 |
| 206 | F G K Q A P A Y V | 16 | 4770 |

TABLE XIXA, PART 1-continued

| Pos | 1 2 3 4 5 6 7 8 9 | score | SEQ ID |
|---|---|---|---|
| 218 | I A N T Y L L I S | 16 | 4771 |
| 108 | L S Y C H S Q V L | 15 | 4772 |
| 179 | T F S T C V S H I | 15 | 4773 |
| 230 | N P V I Y S V K T | 15 | 4774 |
| 240 | Q I R R A V I K I | 15 | 4775 |
| 12 | D L G L S I S T L | 14 | 4776 |
| 18 | S T L V T M L S I | 14 | 4777 |
| 43 | M F F I K F F T V | 14 | 4778 |
| 66 | V A V S N P L R Y | 14 | 4779 |
| 86 | I G V A S V I R G | 14 | 4780 |
| 102 | V A L L I R L S Y | 14 | 4781 |
| 160 | Y V L I I R T V L | 14 | 4782 |
| 162 | L I I R T V L S V | 14 | 4783 |
| 170 | V A S P E E R K E | 14 | 4784 |
| 172 | S P E E R K E T F | 14 | 4785 |
| 184 | V S H I V A F A I | 14 | 4786 |
| 192 | I Y Y I P L I S L | 14 | 4787 |
| 194 | Y I P L I S L S I | 14 | 4788 |
| 211 | P A Y V H T M I A | 14 | 4789 |
| 226 | S P L M N P V I Y | 14 | 4790 |
| 233 | I Y S V K T K Q I | 14 | 4791 |
| 238 | T K Q I R R A V I | 14 | 4792 |
| 243 | R A V I K I L H S | 14 | 4793 |
| 78 | L T D S R I A Q I | 13 | 4794 |
| 80 | D S R I A Q I G V | 13 | 4795 |
| 99 | T P M V A L L I R | 13 | 4796 |
| 118 | H S Y C Y H P D V | 13 | 4797 |
| 128 | K L S C T D T R I | 13 | 4798 |
| 141 | G L T A M F S T V | 13 | 4799 |
| 148 | T V G V D L L L I | 13 | 4800 |
| 153 | L L L I L L S Y V | 13 | 4801 |
| 187 | I V A F A I Y Y I | 13 | 4802 |
| 188 | V A F A I Y Y I P | 13 | 4803 |
| 217 | M I A N T Y L L I | 13 | 4804 |
| 228 | L M N P V I Y S V | 13 | 4805 |
| 241 | I R R A V I K I L | 13 | 4806 |
| 37 | N A C L S H M F F | 12 | 4807 |
| 38 | A C L S H M F F I | 12 | 4808 |
| 72 | L R Y A M I L T D | 12 | 4809 |
| 74 | Y A M I L T D S R | 12 | 4810 |
| 75 | A M I L T D S R I | 12 | 4811 |
| 96 | L M L T P M V A L | 12 | 4812 |
| 123 | H P D V M K L S C | 12 | 4813 |
| 159 | S Y V L I I R T V | 12 | 4814 |
| 220 | N T Y L L I S P L | 12 | 4815 |
| 5 | L S M L S A T D L | 11 | 4816 |
| 50 | T V M E S S V L L | 11 | 4817 |
| 69 | S N P L R Y A M I | 11 | 4818 |
| 93 | R G L L M L T P M | 11 | 4819 |
| 138 | S A V G L T A M F | 11 | 4820 |
| 145 | M F S T V G V D L | 11 | 4821 |
| 154 | L L I L L S Y V L | 11 | 4822 |
| 180 | F S T C V S H I V | 11 | 4823 |
| 224 | L I S P L M N P V | 11 | 4824 |
| 7 | M L S A T D L G L | 10 | 4825 |
| 16 | S I S T L V T M L | 10 | 4826 |
| 48 | F F T V M E S S V | 10 | 4827 |
| 49 | F T V M E S S V L | 10 | 4828 |
| 64 | R F V A V S N P L | 10 | 4829 |
| 87 | G V A S V I R G L | 10 | 4830 |
| 94 | G L L M L T P M V | 10 | 4831 |
| 97 | M L T P M V A L L | 10 | 4832 |
| 100 | P M V A L L I R L | 10 | 4833 |
| 121 | C Y H P D V M K L | 10 | 4834 |
| 132 | T D T R I N S A V | 10 | 4835 |
| 134 | T R I N S A V G L | 10 | 4836 |
| 140 | V G L T A M F S T | 10 | 4837 |
| 147 | S T V G V D L L L | 10 | 4838 |
| 176 | R K E T F S T C V | 10 | 4839 |
| 232 | V I Y S V K T K Q | 10 | 4840 |
| 23 | M L S I F W F N V | 9 | 4841 |
| 146 | F S T V G V D L L | 9 | 4842 |
| 158 | L S Y V L I I R T | 9 | 4843 |
| 163 | I I R T V L S V A | 9 | 4844 |
| 237 | K T K Q I R R A V | 9 | 4845 |
| 90 | S V I R G L L M L | 8 | 4846 |
| 107 | R L S Y C H S Q V | 8 | 4847 |

TABLE XIXA, PART 1-continued

| Pos | 1 2 3 4 5 6 7 8 9 | score | SEQ ID |
|---|---|---|---|
| 136 | I N S A V G L T A | 8 | 4848 |
| 150 | G V D L L L I L L | 8 | 4849 |
| 152 | D L L I L L S Y | 8 | 4850 |
| 189 | A F A I Y Y I P L | 8 | 4851 |
| 215 | H T M I A N T Y L | 8 | 4852 |
| 216 | T M I A N T Y L L | 8 | 4853 |
| 15 | L S I S T L V T M | 7 | 4854 |
| 24 | L S I F W F N V R | 7 | 4855 |
| 32 | R E I S F N A C L | 7 | 4856 |
| 44 | F F I K F F T V M | 7 | 4857 |
| 63 | D R F V A V S N P | 7 | 4858 |
| 95 | L L M L T P M V A | 7 | 4859 |
| 120 | Y C Y H P D V M K | 7 | 4860 |
| 122 | Y H P D V M K L S | 7 | 4861 |
| 125 | D V M K L S C T D | 7 | 4862 |
| 133 | D T R I N S A V G | 7 | 4863 |
| 144 | A M P S T V G V D | 7 | 4864 |
| 198 | I S L S I V H R F | 7 | 4865 |
| 222 | Y L L I S P L M N | 7 | 4866 |
| 3 | Y F L S M L S A T | 6 | 4867 |
| 40 | L S H M F F I K F | 6 | 4868 |
| 46 | I K F F T V M E S | 6 | 4869 |
| 56 | V L L A M A F D R | 6 | 4870 |
| 110 | Y C H S Q V L H H | 6 | 4871 |
| 142 | L T A M F S T V G | 6 | 4872 |
| 157 | L L S Y V L I I R | 6 | 4873 |
| 166 | T V L S V A S P E | 6 | 4874 |
| 175 | E R K E T F S T C | 6 | 4875 |
| 191 | A I Y Y I P L I S | 6 | 4876 |
| 197 | L I S L S I V H R | 6 | 4877 |
| 231 | P V I Y S V K T K | 6 | 4878 |
| 1 | M Y Y F L S M L S | 5 | 4879 |
| 2 | Y Y F L S M L S A | 5 | 4880 |
| 11 | T D L G L S I S T | 5 | 4881 |
| 14 | G L S I S T L V T | 5 | 4882 |
| 51 | V M E S S V L L A | 5 | 4883 |
| 52 | M E S S V L L A M | 5 | 4884 |
| 61 | A F D R F V A V S | 5 | 4885 |
| 62 | F D R F V A V S N | 5 | 4886 |
| 76 | M I L T D S R I A | 5 | 4887 |
| 77 | I L T D S R I A Q | 5 | 4888 |
| 81 | S R I A Q I G V A | 5 | 4889 |
| 92 | I R G L L M L T P | 5 | 4890 |
| 106 | I R L S Y C H S Q | 5 | 4891 |
| 127 | M K L S C T D T R | 5 | 4892 |
| 151 | V D L L L I L L S | 5 | 4893 |
| 168 | L S V A S P E E R | 5 | 4894 |
| 181 | S T C V S H I V A | 5 | 4895 |
| 207 | G K Q A P A Y V H | 5 | 4896 |
| 213 | Y V H T M I A N T | 5 | 4897 |
| 214 | V H T M I A N T Y | 5 | 4898 |
| 229 | M N P V I Y S V K | 5 | 4899 |
| 236 | V K T K Q I R R A | 5 | 4900 |
| 8 | L S A T D L G L S | 4 | 4901 |
| 17 | I S T L V T M L S | 4 | 4902 |
| 19 | T L V T M L S I F | 4 | 4903 |
| 22 | T M L S I F W F N | 4 | 4904 |
| 25 | S I F W F N V R E | 4 | 4905 |
| 27 | F W F N V R E I S | 4 | 4906 |
| 31 | V R E I S F N A C | 4 | 4907 |
| 34 | I S F N A C L S H | 4 | 4908 |
| 47 | K F F T V M E S S | 4 | 4909 |
| 57 | L L A M A F D R F | 4 | 4910 |
| 105 | L I R L S Y C H S | 4 | 4911 |
| 111 | C H S Q V L H H S | 4 | 4912 |
| 116 | L H H S Y C Y H P | 4 | 4913 |
| 119 | S Y C Y H P D V M | 4 | 4914 |
| 129 | L S C T D T R I N | 4 | 4915 |
| 171 | A S P E E R K E T | 4 | 4916 |
| 177 | K E T F S T C V S | 4 | 4917 |
| 196 | P L I S L S I V H | 4 | 4918 |
| 234 | Y S V K T Q I R | 4 | 4919 |
| 235 | S V K T K Q I R R | 4 | 4920 |
| 4 | F L S M L S A T D | 3 | 4921 |
| 20 | L V T M L S T F W | 3 | 4922 |
| 21 | V T M L S I F W F | 3 | 4923 |
| 30 | N V R E I S F N A | 3 | 4924 |

TABLE XIXA, PART 1-continued

| Pos | 1 2 3 4 5 6 7 8 9 | score | SEQ ID |
|---|---|---|---|
| 35 | S F N A C L S H M | 3 | 4925 |
| 59 | A M A F D R F V A | 3 | 4926 |
| 65 | F V A V S N P L R | 3 | 4927 |
| 91 | V I R G L L M L T | 3 | 4928 |
| 101 | M V A L L T R L S | 3 | 4929 |
| 103 | A L L I R L S Y C | 3 | 4930 |
| 126 | V M K L S C T D T | 3 | 4931 |
| 130 | S C T D T R I N S | 3 | 4932 |
| 131 | C T D T R I N S A | 3 | 4933 |
| 137 | N S A V G L T A M | 3 | 4934 |
| 164 | I R T V L S V A S | 3 | 4935 |
| 165 | R T V L S V A S P | 3 | 4936 |
| 178 | E T F S T C V S H | 3 | 4937 |
| 182 | T C V S H I V A F | 3 | 4938 |
| 186 | H I V A F A I Y Y | 3 | 4939 |
| 193 | Y Y I P L I S L S | 3 | 4940 |
| 199 | S L S I V H R F G | 3 | 4941 |
| 201 | S I V H R F G K Q | 3 | 4942 |
| 202 | I V H R F G K Q A | 3 | 4943 |
| 204 | H R F G K Q A P A | 3 | 4944 |
| 221 | T Y L L I S P L M | 3 | 4945 |
| 223 | L L I S P L M N P | 3 | 4946 |
| 227 | P L M N P V I Y S | 3 | 4947 |
| 245 | V I K I L H S K E | 3 | 4948 |
| 246 | I K I L H S K E T | 3 | 4949 |
| 6 | S M L S A T D L G | 2 | 4950 |
| 29 | F N V R E I S F N | 2 | 4951 |
| 39 | C L S H M F F I K | 2 | 4952 |
| 41 | S H M F F I K F F | 2 | 4953 |
| 45 | F I K F F T V M E | 2 | 4954 |
| 55 | S V L L A M A F D | 2 | 4955 |
| 67 | A V S N P L R Y A | 2 | 4956 |
| 73 | R Y A M I L T D S | 2 | 4957 |
| 79 | T D S R I A Q I G | 2 | 4958 |
| 104 | L L I R L S Y C H | 2 | 4959 |
| 109 | S Y C H S Q V L H | 2 | 4960 |
| 114 | Q V L H H S Y C Y | 2 | 4961 |
| 115 | V L H H S Y C Y H | 2 | 4962 |
| 124 | P D V M K L S C T | 2 | 4963 |
| 135 | R I N S A V G L T | 2 | 4964 |
| 139 | A V G L T A M F S | 2 | 4965 |
| 161 | V L I I R T V L S | 2 | 4966 |
| 173 | P E E R K E T F S | 2 | 4967 |
| 183 | C V S H I V A F A | 2 | 4968 |
| 200 | L S I V H R F G K | 2 | 4969 |
| 205 | R F G K Q A P A Y | 2 | 4970 |
| 208 | K Q A P A Y V H T | 2 | 4971 |
| 212 | A Y V H T M I A N | 2 | 4972 |
| 219 | A N T Y L L I S P | 2 | 4973 |
| 239 | K Q I R R A V I K | 2 | 4974 |
| 244 | A V I K I L H S K | 2 | 4975 |
| 10 | A T D L G L S I S | 1 | 4976 |
| 28 | W F N V R E I S F | 1 | 4977 |
| 33 | E I S F N A C L S | 1 | 4978 |
| 36 | F N A C L S H M F | 1 | 4979 |
| 42 | H M F F I K F F T | 1 | 4980 |
| 53 | E S S V L L A M A | 1 | 4981 |
| 54 | S S V L L A M A F | 1 | 4982 |
| 68 | V S N P L R Y A M | 1 | 4983 |
| 71 | P L R Y A M T L T | 1 | 4984 |

TABLE XIXA part 2

| Pos | 1 | 2 | 3 | 4 | 5 | 6 | 7 | 8 | 9 | score | SEQ ID |
|---|---|---|---|---|---|---|---|---|---|---|---|
| HLA-A*0201 9-mers v.1B: 238P1B2 | | | | | | | | | | | |
| 16 | F | L | L | T | G | <u>V</u> | P | G | L | 31 | 4985 |
| 13 | S | I | I | F | L | <u>L</u> | T | G | V | 27 | 4986 |
| 42 | A | L | L | G | N | <u>S</u> | L | I | L | 27 | 4987 |
| 32 | S | I | P | F | C | <u>F</u> | L | S | V | 22 | 4988 |
| 40 | V | T | A | L | L | <u>G</u> | N | S | L | 21 | 4989 |
| 1 | F | I | T | S | T | <u>L</u> | Q | N | I | 20 | 4990 |
| 9 | I | T | S | T | S | <u>I</u> | I | F | L | 20 | 4991 |
| 62 | P | M | Y | Y | F | <u>L</u> | S | M | L | 20 | 4992 |
| 23 | G | L | E | A | F | <u>H</u> | T | W | I | 19 | 4993 |
| 30 | W | I | S | I | P | <u>F</u> | C | F | L | 19 | 4994 |
| 47 | S | L | I | L | F | <u>A</u> | T | I | T | 19 | 4995 |
| 4 | S | T | L | Q | N | <u>I</u> | T | S | T | 18 | 4996 |
| 35 | F | C | F | L | S | <u>V</u> | T | A | L | 17 | 4997 |
| 49 | I | L | F | A | T | <u>I</u> | T | Q | P | 17 | 4998 |
| 51 | F | A | T | I | T | <u>Q</u> | P | S | L | 17 | 4999 |
| 36 | C | F | L | S | V | <u>T</u> | A | L | L | 16 | 5000 |
| 41 | T | A | L | L | G | <u>N</u> | S | L | I | 16 | 5001 |
| 43 | L | L | G | N | S | <u>L</u> | I | L | F | 16 | 5002 |
| 58 | S | L | H | E | P | <u>M</u> | Y | Y | F | 16 | 5003 |
| 46 | N | S | L | I | L | <u>F</u> | A | T | I | 15 | 5004 |
| 48 | L | I | L | F | A | <u>T</u> | I | T | Q | 15 | 5005 |
| 54 | I | T | Q | P | S | <u>L</u> | H | E | P | 15 | 5006 |
| 5 | T | L | Q | N | I | <u>T</u> | S | T | S | 14 | 5007 |

TABLE XIXA-continued part 2

| Pos | 1 | 2 | 3 | 4 | 5 | 6 | 7 | 8 | 9 | score | SEQ ID |
|---|---|---|---|---|---|---|---|---|---|---|---|
| 14 | I | I | F | L | L | T | G | V | P | 14 | 5008 |
| 18 | L | T | G | V | P | G | L | E | A | 14 | 5009 |
| 59 | L | H | E | P | M | Y | Y | F | L | 14 | 5010 |
| 6 | L | Q | N | I | T | S | T | S | I | 13 | 5011 |
| 10 | T | S | T | S | I | I | F | L | L | 13 | 5012 |
| 17 | L | L | T | G | V | P | G | L | E | 13 | 5013 |
| 44 | L | G | N | S | L | I | L | F | A | 13 | 5014 |
| 2 | I | T | S | T | L | Q | N | I | T | 12 | 5015 |
| 7 | Q | N | I | T | S | T | S | I | I | 12 | 5016 |
| 25 | E | A | F | H | T | W | I | S | I | 12 | 5017 |
| 33 | I | P | F | C | F | L | S | V | T | 12 | 5018 |
| 37 | F | L | S | V | T | A | L | L | G | 12 | 5019 |
| 11 | S | T | S | I | I | F | L | L | T | 11 | 5020 |
| 12 | T | S | I | I | F | L | L | T | G | 10 | 5021 |
| 20 | G | V | P | G | L | E | A | F | H | 10 | 5022 |
| 28 | H | T | W | I | S | I | P | F | C | 10 | 5023 |
| 39 | S | V | T | A | L | L | G | N | S | 10 | 5024 |
| 45 | G | N | S | L | I | L | F | A | T | 10 | 5025 |
| 19 | T | G | V | P | G | L | E | A | F | 9 | 5026 |
| 53 | T | I | T | Q | P | S | L | H | E | 9 | 5027 |
| 38 | L | S | V | T | A | L | L | G | N | 8 | 5028 |
| 52 | A | T | I | T | Q | P | S | L | H | 8 | 5029 |
| 8 | N | I | T | S | T | S | I | I | F | 7 | 5030 |
| 31 | I | S | T | P | F | C | F | L | S | 7 | 5031 |
| 15 | I | F | L | L | T | G | V | P | G | 6 | 5032 |
| 26 | A | F | H | T | W | I | S | I | P | 6 | 5033 |
| 50 | L | F | A | T | I | T | Q | P | S | 6 | 5034 |
| 21 | V | P | G | L | E | A | F | H | T | 5 | 5035 |
| 24 | L | E | A | F | H | T | W | I | S | 5 | 5036 |
| 34 | P | F | C | F | L | S | V | T | A | 5 | 5037 |
| 55 | T | Q | P | S | L | H | E | P | M | 5 | 5038 |
| 61 | E | P | M | Y | Y | F | L | S | M | 5 | 5039 |
| 22 | P | G | L | E | A | F | H | T | W | 4 | 5040 |
| 29 | T | W | I | S | I | P | F | C | F | 2 | 5041 |
| 3 | T | S | T | L | Q | N | I | T | S | 1 | 5042 |
| 56 | Q | P | S | L | H | E | P | M | Y | 1 | 5043 |
| 60 | H | E | P | M | Y | Y | F | L | S | 1 | 5044 |
| 57 | P | S | L | H | E | P | M | Y | Y | -1 | 5045 |

HLA-A1 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 11 | S | T | S | I | I | F | L | L | T | 19 | 5046 |
| 57 | P | S | L | H | E | P | M | Y | Y | 19 | 5047 |
| 56 | Q | P | S | L | H | E | P | M | Y | 16 | 5048 |
| 18 | L | T | G | V | P | G | L | E | A | 14 | 5049 |
| 59 | L | H | E | P | M | Y | Y | F | L | 14 | 5050 |
| 3 | T | S | T | L | Q | N | I | T | S | 11 | 5051 |
| 23 | G | L | E | A | F | H | T | W | I | 11 | 5052 |
| 32 | S | I | P | F | C | F | L | S | V | 11 | 5053 |
| 52 | A | T | I | T | Q | P | S | L | H | 11 | 5054 |
| 9 | I | T | S | T | S | I | I | F | L | 10 | 5055 |
| 12 | T | S | I | I | F | L | L | T | G | 10 | 5056 |
| 31 | I | S | I | P | F | C | F | L | S | 10 | 5057 |
| 37 | F | L | S | V | T | A | L | L | G | 10 | 5058 |
| 38 | L | S | V | T | A | L | L | G | N | 10 | 5059 |
| 54 | I | T | Q | P | S | L | H | E | P | 10 | 5060 |
| 61 | E | P | M | Y | Y | F | L | S | M | 10 | 5061 |
| 4 | A | L | Q | N | I | T | S | T | S | 9 | 5062 |
| 4 | S | T | L | Q | N | I | T | S | T | 8 | 5063 |
| 40 | V | T | A | L | L | G | N | S | L | 8 | 5064 |
| 43 | L | L | G | N | S | L | I | L | F | 7 | 5065 |
| 46 | N | S | L | I | L | F | A | T | I | 7 | 5066 |
| 53 | T | I | T | Q | P | S | L | H | E | 7 | 5067 |
| 2 | I | T | S | T | L | Q | N | I | T | 6 | 5068 |
| 10 | T | S | T | S | I | I | F | L | L | 6 | 5069 |
| 17 | L | L | T | G | V | P | G | L | E | 6 | 5070 |
| 19 | T | G | V | P | G | L | E | A | F | 6 | 5071 |
| 28 | H | T | W | I | S | I | P | F | C | 6 | 5072 |
| 44 | L | G | N | S | L | I | L | F | A | 6 | 5073 |
| 16 | F | L | L | T | G | V | P | G | L | 5 | 5074 |
| 27 | F | H | T | W | I | S | I | P | F | 5 | 5075 |
| 41 | T | A | L | L | G | N | S | L | I | 5 | 5076 |
| 8 | N | I | T | S | T | S | I | I | F | 4 | 5077 |
| 25 | E | A | F | H | T | W | I | S | I | 4 | 5078 |
| 30 | W | I | S | I | P | F | C | F | L | 4 | 5079 |
| 36 | C | F | L | S | V | T | A | L | L | 4 | 5080 |
| 48 | L | I | L | F | A | T | I | T | Q | 4 | 5081 |
| 58 | S | L | H | E | P | M | Y | Y | F | 4 | 5082 |
| 22 | P | G | L | E | A | F | H | T | W | 3 | 5083 |
| 47 | S | L | I | L | F | A | T | I | T | 3 | 5084 |
| 60 | H | E | P | M | Y | Y | F | L | S | 3 | 5085 |
| 13 | S | I | I | F | L | L | T | G | V | 2 | 5086 |
| 35 | F | C | F | L | S | V | T | A | L | 2 | 5087 |
| 39 | S | V | T | A | L | L | G | N | S | 2 | 5088 |
| 1 | F | I | T | S | T | L | Q | N | I | 1 | 5089 |
| 5 | T | L | Q | N | T | T | S | T | S | 1 | 5090 |
| 14 | I | I | F | L | L | T | G | V | P | 1 | 5091 |
| 15 | I | F | L | L | T | G | V | P | G | 1 | 5092 |
| 20 | G | V | P | G | L | E | A | F | H | 1 | 5093 |
| 21 | V | P | G | L | E | A | F | H | T | 1 | 5094 |
| 26 | A | F | H | T | W | I | S | I | P | 1 | 5095 |
| 33 | I | P | F | C | F | L | S | V | T | 1 | 5096 |
| 49 | I | L | F | A | T | I | T | Q | P | 1 | 5097 |
| 51 | F | A | T | I | T | Q | P | S | L | 1 | 5098 |
| 62 | P | M | Y | Y | F | L | S | M | L | 1 | 5099 |

HLA-A26 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 58 | S | L | H | E | P | M | Y | F | | 24 | 5100 |
| 9 | I | T | S | T | S | I | I | F | L | 23 | 5101 |
| 43 | L | G | N | S | L | I | L | F | | 23 | 5102 |
| 16 | F | L | L | T | G | V | P | G | L | 22 | 5103 |
| 30 | W | I | S | I | P | F | C | F | L | 22 | 5104 |
| 8 | N | I | T | S | T | S | I | I | F | 21 | 5105 |
| 40 | V | T | A | L | L | G | N | S | L | 21 | 5106 |
| 61 | E | P | M | Y | Y | F | L | S | M | 19 | 5107 |
| 13 | S | I | I | F | L | L | T | G | V | 18 | 5108 |
| 42 | A | L | L | G | N | S | L | I | L | 18 | 5109 |
| 54 | I | T | Q | P | S | L | H | E | P | 18 | 5110 |
| 1 | F | I | T | S | T | L | Q | N | I | 17 | 5111 |
| 19 | T | G | V | P | G | L | E | A | F | 17 | 5112 |
| 4 | S | T | L | Q | N | I | T | S | T | 16 | 5113 |
| 28 | H | T | W | I | S | I | P | F | G | 16 | 5114 |
| 32 | S | I | P | F | C | F | L | S | V | 16 | 5115 |
| 35 | F | C | F | L | S | V | T | A | L | 16 | 5116 |
| 36 | C | F | L | S | V | T | A | L | L | 16 | 5117 |
| 39 | S | V | T | A | L | L | G | N | S | 16 | 5118 |
| 20 | G | V | P | G | L | E | A | F | H | 15 | 5119 |
| 49 | I | L | F | A | T | I | T | Q | P | 15 | 5120 |
| 11 | S | T | S | I | I | F | L | L | T | 14 | 5121 |
| 52 | A | T | I | T | Q | P | S | L | H | 14 | 5122 |
| 59 | L | H | E | P | M | Y | Y | F | L | 14 | 5123 |
| 62 | P | M | Y | Y | F | L | S | M | L | 14 | 5124 |
| 10 | T | S | T | S | I | I | F | L | L | 13 | 5125 |
| 14 | I | I | F | L | L | T | G | V | P | 13 | 5126 |
| 29 | T | W | I | S | I | P | F | C | F | 13 | 5127 |
| 53 | T | I | T | Q | P | S | L | H | E | 12 | 5128 |
| 56 | Q | P | S | L | H | E | P | M | Y | 12 | 5129 |
| 2 | I | T | S | T | L | Q | N | I | T | 11 | 5130 |
| 18 | L | T | G | V | P | G | L | E | A | 11 | 5131 |
| 26 | A | F | H | T | W | I | S | I | P | 11 | 5132 |
| 55 | T | Q | P | S | L | H | E | P | M | 11 | 5133 |
| 57 | P | S | L | H | E | P | M | Y | Y | 11 | 5134 |
| 17 | L | L | T | G | V | P | G | L | E | 10 | 5135 |
| 27 | F | H | T | W | I | S | I | P | F | 10 | 5136 |
| 47 | S | L | I | L | F | A | T | I | T | 10 | 5137 |
| 48 | L | I | L | F | A | T | I | T | Q | 10 | 5138 |
| 51 | F | A | T | I | T | Q | P | S | L | 10 | 5139 |
| 5 | T | L | Q | N | I | T | S | T | S | 9 | 5140 |
| 25 | E | A | F | H | T | W | I | S | I | 9 | 5141 |
| 23 | G | L | E | A | F | H | T | W | I | 8 | 5142 |
| 34 | P | F | C | F | L | S | V | T | A | 8 | 5143 |
| 37 | F | L | S | V | T | A | L | L | G | 8 | 5144 |
| 50 | L | F | A | T | I | T | Q | P | S | 8 | 5145 |
| 15 | I | F | L | L | T | G | V | P | G | 7 | 5146 |
| 33 | I | P | F | C | F | L | S | V | T | 7 | 5147 |
| 12 | T | S | I | I | F | L | L | T | G | 6 | 5148 |
| 22 | P | G | L | E | A | F | H | T | W | 6 | 5149 |
| 44 | L | G | N | S | L | I | L | F | A | 6 | 5150 |
| 46 | N | S | L | I | L | F | A | T | I | 6 | 5151 |

TABLE XIXA-continued part 2

| Pos | 1 | 2 | 3 | 4 | 5 | 6 | 7 | 8 | 9 | score | SEQ ID |
|---|---|---|---|---|---|---|---|---|---|---|---|
| 38 | L | S | V | T | A | L | L | G | N | 5 | 5152 |
| 45 | G | N | S | L | I | L | F | A | T | 5 | 5153 |
| 60 | H | E | P | M | Y | Y | F | L | S | 5 | 5154 |
| 7 | Q | N | I | T | S | T | S | I | I | 4 | 5155 |
| 31 | I | S | I | P | F | C | F | L | S | 4 | 5156 |
| 3 | T | S | T | L | Q | N | I | T | S | 1 | 5157 |
| 6 | L | Q | N | I | T | S | T | S | I | 1 | 5158 |
| 21 | V | P | G | L | E | A | F | H | T | 1 | 5159 |
| 24 | L | E | A | F | H | T | W | I | S | 1 | 5160 |
| 41 | T | A | L | L | G | N | S | L | I | 1 | 5161 |

HLA-A3 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 42 | A | L | L | G | N | S | L | I | L | 20 | 5162 |
| 20 | G | V | P | G | L | E | A | F | H | 19 | 5163 |
| 47 | S | L | I | L | F | A | T | I | T | 19 | 5164 |
| 5 | T | L | Q | N | I | T | S | T | S | 18 | 5165 |
| 49 | I | L | F | A | T | I | T | Q | P | 18 | 5166 |
| 14 | I | I | F | L | L | T | G | V | P | 16 | 5167 |
| 37 | F | L | S | V | T | A | L | L | G | 16 | 5168 |
| 58 | S | L | H | E | P | M | Y | Y | F | 16 | 5169 |
| 17 | L | L | T | G | V | P | G | L | E | 15 | 5170 |
| 43 | L | L | G | N | S | L | I | L | F | 15 | 5171 |
| 16 | F | L | L | T | G | V | P | G | L | 14 | 5172 |
| 23 | G | L | E | A | F | H | T | W | I | 14 | 5173 |
| 32 | S | I | P | F | C | F | L | S | V | 14 | 5174 |
| 39 | S | V | T | A | L | L | G | N | S | 14 | 5175 |
| 48 | L | I | L | F | A | T | I | T | Q | 14 | 5176 |
| 52 | A | T | I | T | Q | P | S | L | H | 14 | 5177 |
| 13 | S | I | I | F | L | L | T | G | V | 13 | 5178 |
| 8 | N | I | T | S | T | S | I | I | F | 12 | 5179 |
| 15 | I | F | L | L | T | G | V | P | G | 12 | 5180 |
| 12 | T | S | I | I | F | L | L | T | G | 11 | 5181 |
| 53 | T | I | T | Q | P | S | L | H | E | 11 | 5182 |
| 19 | T | G | V | P | G | L | E | A | F | 10 | 5183 |
| 46 | N | S | L | I | L | F | A | T | I | 10 | 5184 |
| 56 | Q | P | S | L | H | E | P | M | Y | 10 | 5185 |
| 57 | P | S | L | H | E | P | M | Y | Y | 10 | 5186 |
| 30 | W | I | S | I | P | F | C | F | L | 9 | 5187 |
| 33 | I | P | F | C | F | L | S | V | T | 9 | 5188 |
| 1 | F | I | T | S | T | L | Q | N | I | 8 | 5189 |
| 7 | Q | N | I | T | S | T | S | I | I | 8 | 5190 |
| 29 | T | W | I | S | I | P | F | C | F | 8 | 5191 |
| 31 | I | S | I | P | F | C | F | L | S | 8 | 5192 |
| 34 | P | F | C | F | L | S | V | T | A | 8 | 5193 |
| 41 | T | A | L | L | G | N | S | L | I | 8 | 5194 |
| 62 | M | Y | Y | F | L | S | M | L | L | 8 | 5195 |
| 22 | P | G | L | E | A | F | H | T | W | 7 | 5196 |
| 40 | V | T | A | L | L | G | N | S | L | 7 | 5197 |
| 4 | S | T | L | Q | N | I | T | S | T | 6 | 5198 |
| 18 | L | T | G | V | P | G | L | E | A | 6 | 5199 |
| 26 | A | F | H | T | W | I | S | I | P | 6 | 5200 |
| 36 | C | F | L | S | V | T | A | L | L | 6 | 5201 |
| 3 | T | S | T | L | Q | N | I | T | S | 5 | 5202 |
| 11 | S | T | S | I | I | F | L | L | T | 5 | 5203 |
| 54 | I | T | Q | P | S | L | H | E | P | 5 | 5204 |
| 61 | E | P | M | Y | Y | F | L | S | M | 5 | 5205 |
| 6 | L | Q | N | I | T | S | T | S | I | 4 | 5206 |
| 21 | V | P | G | L | E | A | F | H | T | 4 | 5207 |
| 27 | F | H | T | W | I | S | I | P | F | 4 | 5208 |
| 35 | F | C | F | L | S | V | T | A | L | 3 | 5209 |
| 38 | L | S | V | T | A | L | L | G | N | 3 | 5210 |
| 44 | L | G | N | S | L | I | L | F | A | 3 | 5211 |
| 51 | F | A | T | I | T | Q | P | S | L | 3 | 5212 |
| 59 | L | H | E | P | M | Y | Y | F | L | 3 | 5213 |
| 2 | I | T | S | T | L | Q | N | I | T | 2 | 5214 |
| 9 | I | T | S | T | S | I | I | F | L | 2 | 5215 |
| 25 | E | A | F | H | T | W | I | S | I | 2 | 5216 |
| 45 | G | N | S | L | I | L | F | A | T | 2 | 5217 |
| 2 | L | E | A | F | H | T | W | I | S | 1 | 5218 |
| 28 | H | T | W | I | S | I | P | F | C | 1 | 5219 |
| 50 | L | F | A | T | I | T | Q | P | S | 1 | 5220 |

HLA-B*0702 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 61 | E | P | M | Y | Y | F | L | S | M | 21 | 5221 |
| 33 | I | P | F | C | F | L | S | V | T | 18 | 5222 |
| 21 | V | P | G | L | E | A | F | H | T | 17 | 5223 |
| 30 | W | I | S | I | P | F | C | F | L | 17 | 5224 |
| 42 | A | L | L | G | N | S | L | I | L | 16 | 5225 |
| 9 | I | T | S | T | S | I | I | F | L | 14 | 5226 |
| 18 | L | T | G | V | P | G | L | E | A | 13 | 5227 |
| 35 | F | C | F | L | S | V | T | A | L | 13 | 5228 |
| 56 | Q | P | S | L | H | E | P | M | Y | 13 | 5229 |
| 16 | F | L | L | T | G | V | P | G | L | 12 | 5230 |
| 36 | C | F | L | S | V | T | A | L | L | 12 | 5231 |
| 40 | V | T | A | L | L | G | N | S | L | 12 | 5232 |
| 59 | L | H | E | P | M | Y | Y | F | L | 12 | 5233 |
| 11 | S | T | S | I | I | F | L | L | T | 11 | 5234 |
| 51 | F | A | T | I | T | Q | P | S | L | 11 | 5235 |
| 10 | T | S | T | S | I | I | F | L | L | 10 | 5236 |
| 62 | P | M | Y | Y | F | L | S | M | L | 10 | 5237 |
| 2 | I | T | S | T | L | Q | N | I | T | 9 | 5238 |
| 32 | S | I | P | F | C | F | L | S | V | 9 | 5239 |
| 44 | L | G | N | S | L | I | L | F | A | 9 | 5240 |
| 45 | G | N | S | L | I | L | F | A | T | 9 | 5241 |
| 58 | S | L | H | E | P | M | Y | Y | F | 9 | 5242 |
| 19 | T | G | V | P | G | L | E | A | F | 8 | 5243 |
| 23 | G | L | E | A | F | H | T | W | I | 8 | 5244 |
| 34 | P | F | C | F | L | S | V | T | A | 8 | 5245 |
| 46 | N | S | L | I | L | F | A | T | I | 8 | 5246 |
| 4 | S | T | L | Q | N | I | T | S | T | 7 | 5247 |
| 6 | L | Q | N | I | T | S | T | S | I | 7 | 5248 |
| 7 | Q | N | I | T | S | T | S | I | I | 7 | 5249 |
| 13 | S | I | I | F | L | L | T | G | V | 7 | 5250 |
| 25 | E | A | F | H | T | W | I | S | I | 7 | 5251 |
| 27 | F | H | T | W | I | S | I | P | F | 7 | 5252 |
| 43 | L | G | N | S | L | I | L | F | 7 | 5253 |
| 47 | S | L | I | L | F | A | T | I | T | 7 | 5254 |
| 55 | T | Q | P | S | L | H | E | P | M | 7 | 5255 |
| 1 | F | I | T | S | T | L | Q | N | I | 6 | 5256 |
| 8 | N | I | T | S | T | S | I | I | F | 6 | 5257 |
| 29 | T | W | I | S | I | P | F | C | F | 6 | 5258 |
| 41 | T | A | L | L | G | N | S | L | I | 6 | 5259 |
| 15 | I | F | L | L | T | G | V | P | G | 5 | 5260 |
| 53 | T | I | T | Q | P | S | L | H | E | 5 | 5261 |
| 20 | G | V | P | G | L | E | A | F | H | 4 | 5262 |
| 37 | F | L | S | V | T | A | L | L | G | 4 | 5263 |
| 14 | I | I | F | L | L | T | G | V | P | 3 | 5264 |
| 49 | I | L | F | A | T | I | T | Q | P | 3 | 5265 |
| 50 | L | F | A | T | I | T | Q | P | S | 3 | 5266 |
| 12 | T | S | I | I | F | L | L | T | G | 2 | 5267 |
| 17 | L | L | T | G | V | P | G | L | E | 2 | 5268 |
| 24 | L | E | A | F | H | T | W | I | S | 2 | 5269 |
| 26 | A | F | H | T | W | I | S | I | P | 2 | 5270 |
| 28 | H | T | W | I | S | I | P | F | C | 2 | 5271 |
| 31 | I | S | I | P | F | C | F | L | S | 2 | 5272 |
| 38 | L | S | V | T | A | L | L | G | N | 2 | 5273 |
| 52 | A | T | I | T | Q | P | S | L | H | 2 | 5274 |
| 54 | I | T | Q | P | S | L | H | E | P | 2 | 5275 |
| 5 | T | L | Q | N | I | T | S | T | S | 1 | 5276 |
| 22 | P | G | L | E | A | F | H | T | W | 1 | 5277 |
| 39 | S | V | T | A | L | L | G | N | S | 1 | 5278 |
| 48 | L | I | L | F | A | T | I | T | Q | 1 | 5279 |

HLA-B*08 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 16 | F | L | L | T | G | V | P | G | L | 18 | 5280 |
| 42 | A | L | L | G | N | S | L | I | L | 16 | 5281 |
| 58 | S | L | H | E | P | M | Y | Y | F | 16 | 5282 |
| 51 | F | A | T | I | T | Q | P | S | L | 15 | 5283 |
| 30 | W | I | S | I | P | F | C | F | L | 14 | 5284 |
| 35 | F | C | F | L | S | V | T | A | L | 14 | 5285 |
| 23 | G | L | E | A | F | H | T | W | I | 13 | 5286 |
| 9 | I | T | S | T | S | I | I | F | L | 12 | 5287 |
| 25 | E | A | F | H | T | W | I | S | I | 12 | 5288 |
| 40 | V | T | A | L | L | G | N | S | L | 12 | 5289 |
| 41 | T | A | L | L | G | N | S | L | I | 12 | 5290 |

TABLE XIXA-continued part 2

| Pos | 1 | 2 | 3 | 4 | 5 | 6 | 7 | 8 | 9 | score | SEQ ID |
|---|---|---|---|---|---|---|---|---|---|---|---|
| 43 | L | L | G | N | S | L | I | L | F | 12 | 5291 |
| 1 | F | I | T | S | T | L | Q | N | I | 11 | 5292 |
| 10 | T | S | T | S | I | I | F | L | L | 11 | 5293 |
| 62 | P | M | Y | Y | F | L | S | M | L | 11 | 5294 |
| 8 | N | I | T | S | T | S | I | I | F | 10 | 5295 |
| 36 | C | F | L | S | V | T | A | L | L | 10 | 5296 |
| 59 | L | H | E | P | M | Y | Y | F | L | 10 | 5297 |
| 47 | S | L | I | L | F | A | T | I | T | 9 | 5298 |
| 61 | E | P | M | Y | F | L | S | M | | 9 | 5299 |
| 21 | V | P | G | L | E | A | F | H | T | 8 | 5300 |
| 37 | F | L | S | V | T | A | L | L | G | 8 | 5301 |
| 49 | I | L | F | A | T | I | T | Q | P | 8 | 5302 |
| 19 | T | G | V | P | G | L | E | A | F | 7 | 5303 |
| 27 | F | H | T | W | I | S | I | P | F | 7 | 5304 |
| 33 | I | P | F | C | F | L | S | V | T | 7 | 5305 |
| 56 | Q | P | S | L | H | E | P | M | Y | 7 | 5306 |
| 5 | T | L | Q | N | I | T | S | T | S | 6 | S307 |
| 6 | L | Q | N | I | T | S | T | S | I | 6 | S308 |
| 7 | Q | N | I | T | S | T | S | I | I | 6 | 5309 |
| 13 | S | I | F | L | L | T | G | V | P | 6 | 5310 |
| 14 | I | I | F | L | L | T | G | V | P | 6 | 5311 |
| 17 | L | L | T | G | V | P | G | L | E | 6 | 5312 |
| 29 | T | W | I | S | I | P | F | C | F | 6 | 5313 |
| 32 | S | I | P | F | C | F | L | S | V | 6 | 5314 |
| 46 | N | S | L | I | L | F | A | T | I | 6 | 5315 |
| 48 | L | I | L | F | A | T | I | T | Q | 4 | 5316 |
| 53 | T | I | T | Q | P | S | L | H | E | 4 | 5317 |
| 4 | S | T | L | Q | N | I | T | S | T | 3 | 5318 |
| 15 | I | F | L | L | T | G | V | P | G | 3 | 5319 |
| 45 | G | N | S | L | I | L | F | A | T | 3 | 5320 |
| 3 | T | S | T | L | Q | N | I | T | S | 2 | 5321 |
| 11 | S | T | S | I | I | F | L | L | T | 2 | 5322 |
| 18 | L | T | G | V | P | G | L | E | A | 2 | 5323 |
| 22 | P | G | L | E | A | F | H | T | W | 2 | 5324 |
| 28 | H | T | W | I | S | I | P | F | C | 2 | 5325 |
| 39 | S | V | T | A | L | L | G | N | S | 2 | 5326 |
| 54 | I | T | Q | P | S | L | H | E | P | 2 | 5327 |
| 2 | I | T | S | T | L | Q | N | I | T | 1 | 5328 |
| 20 | G | V | P | G | L | E | A | F | H | 1 | 5329 |
| 26 | A | F | H | T | W | I | S | I | P | 1 | 5330 |
| 31 | I | S | I | P | F | C | F | L | S | 1 | 5331 |
| 34 | P | F | C | F | L | S | V | T | A | 1 | 5332 |
| 44 | L | G | N | S | L | I | L | F | A | 1 | 5333 |
| 60 | H | E | P | M | Y | Y | F | L | S | 1 | 5334 |

HLA-B*1510 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 59 | L | H | E | P | M | Y | Y | F | L | 23 | 5335 |
| 27 | F | H | T | W | I | S | I | P | F | 16 | 5336 |
| 9 | I | T | S | T | S | I | I | F | L | 14 | 5337 |
| 16 | F | L | L | T | G | V | P | G | L | 13 | 5338 |
| 10 | T | S | T | S | I | I | F | L | L | 12 | 5339 |
| 30 | W | I | S | I | P | F | C | F | L | 12 | 5340 |
| 35 | F | C | F | L | S | V | T | A | L | 12 | 5341 |
| 42 | A | L | L | G | N | S | L | I | L | 12 | 5342 |
| 19 | T | G | V | P | G | L | E | A | F | 11 | 5343 |
| 40 | V | T | A | L | L | G | N | S | L | 11 | 5344 |
| 51 | F | A | T | I | T | Q | P | S | L | 11 | 5345 |
| 36 | C | F | L | S | V | T | A | L | L | 10 | 5346 |
| 62 | P | M | Y | Y | F | L | S | M | L | 10 | 5347 |
| 58 | S | L | H | E | P | M | Y | Y | F | 9 | 5348 |
| 29 | W | I | S | I | P | F | C | F | L | 8 | 5349 |
| 55 | T | Q | P | S | L | H | E | P | M | 7 | 5350 |
| 61 | E | P | M | Y | Y | F | L | S | M | 7 | 5351 |
| 8 | N | I | T | S | T | S | I | I | F | 6 | 5352 |
| 43 | L | L | G | N | S | L | I | L | F | 6 | 5353 |
| 54 | I | T | Q | P | S | L | H | E | P | 5 | 5354 |
| 14 | I | I | F | L | L | T | G | V | P | 4 | 5355 |
| 15 | I | F | L | L | T | G | V | P | G | 4 | 5356 |
| 31 | I | S | I | P | F | C | F | L | S | 4 | 5357 |
| 33 | I | P | F | C | F | L | S | V | T | 4 | 5358 |
| 2 | I | T | S | T | L | Q | N | I | T | 3 | 5359 |
| 4 | S | T | L | Q | N | I | T | S | T | 3 | 5360 |
| 18 | L | T | G | V | P | G | L | E | A | 3 | 5361 |
| 34 | P | F | C | F | L | S | V | T | A | 3 | 5362 |
| 45 | G | N | S | L | I | L | F | A | T | 3 | 5363 |
| 49 | I | L | F | A | T | I | T | Q | P | 3 | 5364 |
| 53 | T | I | T | Q | P | S | L | H | E | 3 | 5365 |
| 3 | T | S | T | L | Q | N | I | T | S | 2 | 5366 |
| 5 | T | L | Q | N | I | T | S | T | S | 2 | 5367 |
| 12 | T | S | I | I | F | L | L | T | G | 2 | 5368 |
| 17 | L | L | T | G | V | P | G | L | E | 2 | 5369 |
| 20 | G | V | P | G | L | E | A | F | H | 2 | 5370 |
| 22 | P | G | L | E | A | F | H | T | W | 2 | 5371 |
| 23 | G | L | E | A | F | H | T | W | I | 2 | 5372 |
| 28 | H | T | W | I | S | I | P | F | C | 2 | 5373 |
| 37 | F | L | S | V | T | A | L | L | G | 2 | 5374 |
| 41 | T | A | L | L | G | N | S | L | I | 2 | 5375 |
| 56 | Q | P | S | L | H | E | P | M | Y | 2 | 5376 |
| 11 | S | T | S | I | I | F | L | L | T | 1 | 5377 |
| 24 | L | E | A | F | H | T | W | I | S | 1 | 5378 |
| 25 | E | A | F | H | T | W | I | S | I | 1 | 5379 |
| 26 | A | F | H | T | W | I | S | I | P | 1 | 5380 |
| 44 | L | G | N | S | L | I | L | F | A | 1 | 5381 |
| 46 | N | S | L | I | L | F | A | T | I | 1 | 5382 |
| 48 | L | I | L | F | A | T | I | T | Q | 1 | 5383 |
| 50 | L | F | A | T | I | T | Q | P | S | 1 | 5384 |
| 52 | A | T | I | T | Q | P | S | L | H | 1 | 5385 |
| 57 | P | S | L | H | E | P | M | Y | Y | 1 | 5386 |

HLA-B*2705 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 35 | F | C | F | L | S | V | T | A | L | 18 | 5387 |
| 42 | A | L | L | G | N | S | L | I | L | 17 | 5388 |
| 9 | I | T | S | T | S | I | I | F | L | 16 | 5389 |
| 16 | F | L | L | T | G | V | P | G | L | 16 | 5390 |
| 19 | T | G | V | P | G | L | E | A | F | 15 | 5391 |
| 20 | G | V | P | G | L | E | A | F | H | 15 | 5392 |
| 10 | T | S | T | S | I | T | F | L | L | 14 | 5393 |
| 36 | C | F | L | S | V | T | A | L | L | 14 | 5394 |
| 40 | V | T | A | L | L | G | N | S | L | 14 | 5395 |
| 51 | F | A | T | I | T | Q | P | S | L | 14 | 5396 |
| 62 | P | M | Y | Y | F | L | S | M | L | 14 | 5397 |
| 27 | F | H | T | W | I | S | I | P | F | 13 | 5398 |
| 29 | T | W | I | S | I | P | F | C | F | 13 | 5399 |
| 41 | T | A | L | L | G | N | S | L | I | 13 | 5400 |
| 43 | L | L | G | N | S | L | I | L | F | 13 | 5401 |
| 58 | S | L | H | E | P | M | Y | Y | F | 13 | 5402 |
| 8 | N | I | T | S | T | S | I | I | F | 12 | 5403 |
| 52 | A | T | I | T | Q | P | S | L | H | 12 | 5404 |
| 57 | P | S | L | H | E | P | M | Y | Y | 12 | 5405 |
| 59 | L | H | E | P | M | Y | Y | F | L | 12 | 5406 |
| 23 | G | L | E | A | F | H | T | W | I | 11 | 5407 |
| 25 | E | A | F | H | T | W | I | S | I | 11 | 5408 |
| 30 | W | I | S | I | P | F | C | F | L | 11 | 5409 |
| 46 | N | S | L | I | L | F | A | T | I | 11 | 5410 |
| 4 | S | T | L | Q | N | I | T | S | T | 10 | 5411 |
| 6 | L | Q | N | I | T | S | T | S | I | 10 | 5412 |
| 7 | Q | N | I | T | S | T | S | I | I | 10 | 5413 |
| 49 | I | L | F | A | T | I | T | Q | P | 10 | 5414 |
| 56 | Q | P | S | L | H | E | P | M | Y | 10 | 5415 |
| 61 | E | P | M | Y | Y | F | L | S | M | 10 | 5416 |
| 1 | F | I | T | S | T | L | Q | N | I | 9 | 5417 |
| 55 | T | Q | P | S | L | H | E | P | M | 9 | 5418 |
| 14 | I | I | F | L | L | T | G | V | P | 7 | 5419 |
| 33 | I | P | F | G | F | L | S | V | T | 7 | 5420 |
| 13 | S | I | F | L | L | T | G | V | | 6 | 5421 |
| 45 | G | N | S | L | I | L | F | A | T | 6 | 5422 |
| 47 | S | L | I | L | F | A | T | I | T | 6 | 5423 |
| 2 | I | T | S | T | L | Q | N | I | T | 5 | 5424 |
| 12 | T | S | I | I | F | L | L | T | G | 5 | 5425 |
| 15 | I | F | L | L | T | G | V | P | | 5 | 5426 |
| 26 | A | F | H | T | W | I | S | I | P | 5 | 5427 |
| 28 | H | T | W | I | S | I | P | F | C | 5 | 5428 |
| 44 | L | G | N | S | L | I | L | F | A | 5 | 5429 |
| 53 | T | I | T | Q | P | S | L | H | E | 5 | 5430 |
| 54 | I | T | Q | P | S | L | H | E | P | 5 | 5431 |
| 3 | T | S | T | L | Q | N | I | T | S | 4 | 5432 |
| 22 | P | G | L | E | A | F | H | T | W | 4 | 5433 |
| 31 | I | S | I | P | F | C | F | L | S | 4 | 5434 |

TABLE XIXA-continued part 2

| Pos | 1 | 2 | 3 | 4 | 5 | 6 | 7 | 8 | 9 | score | SEQ ID |
|---|---|---|---|---|---|---|---|---|---|---|---|
| 34 | P | F | C | F | L | S | V | T | A | 4 | 5435 |
| 39 | S | V | T | A | L | L | G | N | S | 4 | 5436 |
| 48 | L | I | L | F | A | T | I | T | Q | 4 | 5437 |
| 5 | T | L | Q | N | I | T | S | T | S | 3 | 5438 |
| 17 | L | L | T | G | V | P | G | L | E | 3 | 5439 |
| 18 | L | T | G | V | P | G | L | E | A | 3 | 5440 |
| 21 | V | P | G | L | E | A | F | H | T | 3 | 5441 |
| 38 | L | S | V | T | A | L | L | G | N | 3 | 5442 |
| 11 | S | T | S | I | I | F | L | L | T | 2 | 5443 |
| 32 | S | I | P | F | C | F | L | S | V | 2 | 5444 |
| 37 | F | L | S | V | T | A | L | L | G | 2 | 5445 |
| 24 | L | E | A | F | H | T | W | I | S | 1 | 5446 |
| 50 | L | F | A | T | I | T | Q | P | S | 1 | 5447 |

HLA-B*2709 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 16 | F | L | L | T | G | V | P | G | L | 14 | 5448 |
| 42 | A | L | L | G | N | S | L | I | L | 14 | 5449 |
| 10 | T | S | T | S | I | I | F | L | L | 13 | 5450 |
| 35 | F | C | F | L | S | V | T | A | L | 13 | 5451 |
| 36 | C | F | L | S | V | T | A | L | L | 13 | 5452 |
| 51 | F | A | T | I | T | Q | P | S | L | 12 | 5453 |
| 59 | L | H | E | P | M | Y | Y | F | L | 12 | 5454 |
| 62 | P | M | Y | Y | F | L | S | M | L | 12 | 5455 |
| 1 | F | I | T | S | T | L | Q | N | I | 11 | 5456 |
| 9 | I | T | S | T | S | I | I | F | L | 11 | 5457 |
| 23 | G | L | E | A | F | H | T | W | I | 11 | 5458 |
| 29 | T | W | I | S | I | P | F | C | F | 11 | 5459 |
| 8 | N | I | T | S | T | S | I | I | F | 10 | 5460 |
| 19 | T | G | V | P | G | L | E | A | F | 10 | 5461 |
| 25 | E | A | F | H | T | W | I | S | I | 10 | 5462 |
| 27 | F | H | T | W | I | S | I | P | F | 10 | 5463 |
| 30 | W | I | S | I | P | F | C | F | L | 10 | 5464 |
| 40 | V | T | A | L | L | G | N | S | L | 10 | 5465 |
| 41 | T | A | L | L | G | N | S | L | I | 10 | 5466 |
| 46 | N | S | L | I | L | F | A | T | I | 10 | 5467 |
| 7 | Q | N | I | T | S | T | S | I | I | 9 | 5468 |
| 13 | S | I | I | F | L | L | T | G | V | 9 | 5469 |
| 32 | S | I | P | F | C | F | L | S | V | 9 | 5470 |
| 55 | T | Q | P | S | L | H | E | P | M | 9 | 5471 |
| 58 | S | L | H | E | P | M | Y | Y | F | 9 | 5472 |
| 61 | E | P | M | Y | Y | F | L | S | M | 9 | 5473 |
| 6 | L | Q | N | I | T | S | T | S | I | 8 | 5474 |
| 43 | L | L | G | N | S | L | I | L | F | 8 | 5475 |
| 15 | I | F | L | L | T | G | V | P | G | 4 | 5476 |
| 45 | G | N | S | L | I | L | F | A | T | 4 | 5477 |
| 49 | I | L | F | A | T | I | T | Q | P | 4 | 5478 |
| 14 | I | I | F | L | L | T | G | V | P | 3 | 5479 |
| 20 | G | V | P | G | L | E | A | F | H | 3 | 5480 |
| 31 | S | I | P | F | C | F | L | S | | 3 | 5481 |
| 33 | I | P | F | C | F | L | S | V | T | 3 | 5482 |
| 4 | S | T | L | Q | N | I | T | S | T | 2 | 5483 |
| 11 | S | T | S | I | I | F | L | L | T | 2 | 5484 |
| 12 | T | S | I | I | F | L | L | T | G | 2 | 5485 |
| 22 | P | G | L | E | A | F | H | T | W | 2 | 5486 |
| 37 | F | L | S | V | T | A | L | L | G | 2 | 5487 |
| 38 | L | S | V | T | A | L | L | G | N | 2 | 5488 |
| 39 | S | V | T | A | L | L | G | N | S | 2 | 5489 |
| 44 | L | G | N | S | L | I | L | F | A | 2 | 5490 |
| 47 | S | L | I | L | F | A | T | I | T | 2 | 5491 |
| 48 | L | I | L | F | A | T | I | T | Q | 2 | 5492 |
| 52 | A | T | I | T | Q | P | S | L | H | 2 | 5493 |
| 53 | T | I | T | Q | P | S | L | H | E | 2 | 5494 |
| 54 | I | T | Q | P | S | L | H | E | P | 2 | 5495 |
| 57 | P | S | L | H | E | P | M | Y | Y | 2 | 5496 |
| 2 | I | T | S | T | L | Q | N | I | T | 1 | 5497 |
| 3 | T | S | T | L | Q | N | I | T | S | 1 | 5498 |
| 5 | T | L | Q | N | I | T | S | T | S | 1 | 5499 |
| 17 | L | L | T | G | V | P | G | L | E | 1 | 5500 |
| 18 | L | T | G | V | P | G | L | E | A | 1 | 5501 |
| 21 | V | P | G | L | E | A | F | H | T | 1 | 5502 |
| 26 | A | F | H | T | W | I | S | I | P | 1 | 5503 |
| 28 | H | T | W | I | S | I | P | F | C | 1 | 5504 |
| 34 | P | F | C | F | L | S | V | T | A | 1 | 5505 |
| 50 | L | F | A | T | I | T | Q | P | S | 1 | 5506 |
| 56 | Q | P | S | L | H | E | P | M | Y | 1 | 5507 |

HLA-B*4402 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 42 | A | L | L | G | N | S | L | I | L | 17 | 5508 |
| 9 | I | T | S | T | S | I | I | F | L | 16 | 5509 |
| 19 | T | G | V | P | G | L | E | A | F | 16 | 5510 |
| 35 | F | C | F | L | S | V | T | A | L | 16 | 5511 |
| 10 | T | S | T | S | I | I | F | L | L | 15 | 5512 |
| 29 | T | W | I | S | I | P | F | C | F | 15 | 5513 |
| 2 | P | G | L | E | A | F | H | T | W | 14 | 5514 |
| 43 | L | L | G | N | S | L | I | L | F | 14 | 5515 |
| 7 | Q | N | I | T | S | T | S | I | I | 13 | 5516 |
| 16 | F | L | L | T | G | V | P | G | L | 13 | 5517 |
| 25 | E | A | F | H | T | W | I | S | I | 13 | 5518 |
| 36 | C | F | L | S | V | T | A | L | L | 13 | 5519 |
| 59 | L | H | E | P | M | Y | Y | F | L | 13 | 5520 |
| 8 | N | I | T | S | T | S | I | I | F | 12 | 5521 |
| 27 | F | H | T | W | I | S | I | P | F | 12 | 5522 |
| 30 | W | I | S | I | P | F | C | F | L | 12 | 5523 |
| 40 | V | T | A | L | L | G | N | S | L | 12 | 5524 |
| 46 | N | S | L | I | L | F | A | T | I | 12 | 5525 |
| 56 | Q | P | S | L | H | E | P | M | Y | 12 | 5526 |
| 57 | P | S | L | H | E | P | M | Y | Y | 12 | 5527 |
| 60 | H | E | P | M | Y | Y | F | L | S | 12 | 5528 |
| 24 | L | E | A | F | H | T | W | I | S | 11 | 5529 |
| 41 | T | A | L | L | G | N | S | L | I | 11 | 5530 |
| 58 | S | L | H | E | P | M | Y | Y | F | 11 | 5531 |
| 62 | P | M | Y | Y | F | L | S | M | L | 11 | 5532 |
| 51 | F | A | T | I | T | Q | P | S | L | 10 | 5533 |
| 1 | F | I | T | S | T | L | Q | N | I | 9 | 5534 |
| 52 | A | T | I | T | Q | P | S | L | H | 9 | 5535 |
| 6 | L | Q | N | I | T | S | T | S | I | 8 | 5536 |
| 23 | G | L | E | A | F | H | T | W | I | 8 | 5537 |
| 26 | A | F | H | T | W | I | S | I | P | 7 | 5538 |
| 31 | S | I | P | F | C | F | L | S | | 7 | 5539 |
| 4 | S | T | L | Q | N | I | T | S | T | 6 | 5540 |
| 11 | S | T | S | I | I | F | L | L | T | 6 | 5541 |
| 12 | T | S | I | I | F | L | L | T | G | 6 | 5542 |
| 45 | G | N | S | L | I | L | F | A | T | 6 | 5543 |
| 47 | S | L | I | L | F | A | T | I | T | 6 | 5544 |
| 49 | I | L | F | A | T | I | T | Q | P | 6 | 5545 |
| 13 | S | I | I | F | L | L | T | G | V | 5 | 5546 |
| 14 | I | I | F | L | L | T | G | V | P | 5 | 5547 |
| 54 | I | T | Q | P | S | L | H | E | P | 5 | 5548 |
| 61 | E | P | M | Y | Y | F | L | S | M | 5 | 5549 |
| 5 | T | L | Q | N | I | T | S | T | S | 4 | 5550 |
| 32 | S | I | P | F | C | F | L | S | V | 4 | 5551 |
| 33 | I | P | F | C | F | L | S | V | T | 4 | 5552 |
| 37 | F | L | S | V | T | A | L | L | G | 4 | 5553 |
| 44 | L | G | N | S | L | I | L | F | A | 4 | 5554 |
| 48 | L | I | L | F | A | T | I | T | Q | 4 | 5555 |
| 2 | I | T | S | T | L | Q | N | I | T | 3 | 5556 |
| 3 | T | S | T | L | Q | N | I | T | S | 3 | 5557 |
| 15 | I | F | L | L | T | G | V | P | G | 3 | 5558 |
| 17 | L | L | T | G | V | P | G | L | E | 3 | 5559 |
| 28 | H | T | W | I | S | I | P | F | C | 3 | 5560 |
| 38 | L | S | V | T | A | L | L | G | N | 3 | 5561 |
| 50 | L | F | A | T | I | T | Q | P | S | 3 | 5562 |
| 20 | G | V | P | G | L | E | A | F | H | 2 | 5563 |
| 21 | V | P | G | L | E | A | F | H | T | 2 | 5564 |
| 34 | P | F | C | F | L | S | V | T | A | 2 | 5565 |
| 39 | S | V | T | A | L | L | G | N | S | 2 | 5566 |
| 18 | L | T | G | V | P | G | L | E | A | 1 | 5567 |
| 53 | T | I | T | Q | P | S | L | H | E | 1 | 5568 |
| 55 | T | Q | P | S | L | H | E | P | M | 1 | 5569 |

HLA-B*5101 9-mers v.1B: 238P1B2

| Pos | 1 | 2 | 3 | 4 | 5 | 6 | 7 | 8 | 9 | score | SEQ ID |
|---|---|---|---|---|---|---|---|---|---|---|---|
| 41 | T | A | L | L | G | N | S | L | I | 24 | 5570 |
| 25 | E | A | F | H | T | W | I | S | I | 23 | 5571 |
| 51 | F | A | T | I | T | Q | P | S | L | 18 | 5572 |
| 33 | I | P | F | C | F | L | S | V | T | 17 | 5573 |
| 46 | N | S | L | I | L | F | A | T | I | 16 | 5574 |

TABLE XIXA-continued part 2

| Pos | 1 | 2 | 3 | 4 | 5 | 6 | 7 | 8 | 9 | score | SEQ ID |
|---|---|---|---|---|---|---|---|---|---|---|---|
| 6 | L | Q | N | I | T | S | T | S | I | 14 | 5575 |
| 1 | F | I | T | S | T | L | Q | N | I | 13 | 5576 |
| 21 | V | P | G | L | E | A | F | H | T | 13 | 5577 |
| 22 | P | G | L | E | A | F | H | T | W | 13 | 5578 |
| 61 | E | P | M | Y | Y | F | L | S | M | 13 | 5579 |
| 7 | Q | N | I | T | S | T | S | I | I | 12 | 5580 |
| 9 | I | T | S | T | S | I | I | F | L | 12 | 5581 |
| 16 | F | L | L | T | C | V | P | G | L | 12 | 5582 |
| 23 | G | L | E | A | F | H | T | W | I | 12 | 5583 |
| 35 | F | C | F | L | S | V | T | A | L | 12 | 5584 |
| 32 | S | I | P | F | C | F | L | S | V | 11 | 5585 |
| 62 | P | M | Y | Y | F | L | S | M | L | 11 | 5586 |
| 13 | S | I | I | F | L | L | T | G | V | 10 | 5587 |
| 36 | C | F | L | S | V | T | A | L | L | 10 | 5588 |
| 42 | A | L | L | G | N | S | L | I | L | 10 | 5589 |
| 44 | L | G | N | S | L | I | L | F | A | 10 | 5590 |
| 56 | Q | P | S | L | H | E | P | M | Y | 10 | 5591 |
| 59 | L | H | E | P | M | Y | Y | F | L | 9 | 5592 |
| 10 | T | S | T | S | I | I | F | L | L | 8 | 5593 |
| 19 | T | G | V | P | G | L | E | A | F | 8 | 5594 |
| 40 | V | T | A | L | L | G | N | S | L | 8 | 5595 |
| 30 | W | I | S | I | P | F | C | F | L | 7 | 5596 |
| 48 | L | I | L | F | A | T | I | T | Q | 7 | 5597 |
| 49 | I | L | F | A | T | I | T | Q | P | 7 | 5598 |
| 14 | I | I | F | L | L | T | G | V | P | 6 | 5599 |
| 15 | I | F | L | L | T | G | V | P | G | 6 | 5600 |
| 17 | L | L | T | G | V | P | G | L | E | 6 | 5601 |
| 3 | T | S | T | L | Q | N | I | T | S | 5 | 5602 |
| 12 | T | S | I | I | F | L | L | T | G | 5 | 5603 |
| 38 | L | S | V | T | A | L | L | G | N | 5 | 5604 |
| 43 | L | L | G | N | S | L | I | L | F | 5 | 5605 |
| 2 | I | T | S | T | L | Q | N | I | T | 4 | 5606 |
| 4 | S | T | L | Q | N | I | T | S | T | 4 | 5607 |
| 37 | F | L | S | V | T | A | L | L | G | 4 | 5608 |
| 54 | I | T | Q | P | S | L | H | E | P | 4 | 5609 |
| 5 | T | L | Q | N | I | T | S | T | S | 3 | 5610 |
| 8 | N | I | T | S | T | S | I | I | F | 3 | 5611 |
| 18 | L | T | G | V | P | G | L | E | A | 3 | 5612 |
| 28 | H | T | W | I | S | I | P | F | C | 3 | 5613 |
| 34 | P | F | C | F | L | S | V | T | A | 3 | 5614 |
| 50 | L | F | A | T | I | T | Q | P | S | 3 | 5615 |
| 53 | T | I | T | Q | P | S | L | H | E | 3 | 5616 |
| 57 | P | S | L | H | E | P | M | Y | Y | 3 | 5617 |
| 11 | S | T | S | I | I | F | L | L | T | 2 | 5618 |
| 20 | G | V | P | G | L | E | A | F | H | 2 | 5619 |
| 24 | L | E | A | F | H | T | W | I | S | | 5620 |

TABLE XIXA part 3

| Pos | 1 | 2 | 3 | 4 | 5 | 6 | 7 | 8 | 9 | score | SEQ ID |
|---|---|---|---|---|---|---|---|---|---|---|---|

HLA-A*0201 9-mers v.2: 238P1B2

| 8 | L | T | S | P | L | M | N | P | V | 20 | 5621 |
| 4 | N | T | Y | L | L | T | S | P | L | 18 | 5622 |
| 7 | L | L | T | S | P | L | M | N | P | 16 | 5623 |
| 1 | M | I | A | N | T | Y | L | L | T | 15 | 5624 |
| 2 | I | A | N | T | Y | L | L | T | S | 15 | 5625 |
| 6 | Y | L | L | T | S | P | L | M | N | 15 | 5626 |
| 9 | T | S | P | L | M | N | P | V | I | 9 | 5627 |
| 3 | A | N | T | Y | L | L | T | S | P | 7 | 5628 |
| 5 | T | Y | L | L | T | S | P | L | M | 7 | 5629 |

HLA-A1 9-mers v.2: 238P1B2

| 6 | Y | L | L | T | S | P | L | M | N | 10 | 5630 |
| 8 | L | T | S | P | L | M | N | P | V | 10 | 5631 |
| 1 | M | I | A | N | T | Y | L | L | T | 8 | 5632 |
| 2 | I | A | N | T | Y | L | L | T | S | 7 | 5633 |
| 4 | N | T | Y | L | L | T | S | P | L | 6 | 5634 |

TABLE XIXA-continued part 3

| Pos | 1 | 2 | 3 | 4 | 5 | 6 | 7 | 8 | 9 | score | SEQ ID |
|---|---|---|---|---|---|---|---|---|---|---|---|
| 9 | T | S | P | L | M | N | P | V | I | 6 | 5635 |
| 5 | T | Y | L | L | T | S | P | L | M | 2 | 5636 |
| 7 | L | L | T | S | P | L | M | N | P | 2 | 5637 |
| 3 | A | N | T | Y | L | L | T | S | P | 1 | 5638 |

HLA-A26 9-mers v.2: 238P1B2

| 4 | N | T | Y | L | L | T | S | P | L | 20 | 5639 |
| 8 | L | T | S | P | L | M | N | P | V | 17 | 5640 |
| 1 | M | I | A | N | T | Y | L | L | T | 15 | 5641 |
| 7 | L | L | T | S | P | L | M | N | P | 15 | 5642 |
| 6 | Y | L | L | T | S | P | L | M | N | 10 | 5643 |
| 5 | T | Y | L | L | T | S | P | L | M | 9 | 5644 |
| 3 | A | N | T | Y | L | L | T | S | P | 6 | 5645 |
| 2 | I | A | N | T | Y | L | L | T | S | 4 | 5646 |
| 9 | T | S | P | L | M | N | P | V | I | 2 | 5647 |

HLA-A3 9-mers v.2: 238P1B2

| 6 | Y | L | L | T | S | P | L | M | N | 17 | 5648 |
| 1 | M | I | A | N | T | Y | L | L | T | 13 | 5649 |
| 7 | L | L | T | S | P | L | M | N | P | 11 | 5650 |
| 2 | I | A | N | T | Y | L | L | T | S | 9 | 5651 |
| 4 | N | T | Y | L | L | T | S | P | L | 8 | 5652 |
| 3 | A | N | T | Y | L | L | T | S | P | 6 | 5653 |
| 9 | T | S | P | L | M | N | P | V | I | 5 | 5654 |
| 5 | T | Y | L | L | T | S | P | L | M | 3 | 5655 |
| 8 | L | T | S | P | L | M | N | P | V | 3 | 5656 |

HLA-B*0702 9-mers v.2: 238P1B2

| 4 | N | T | Y | L | L | T | S | P | L | 12 | 5657 |
| 8 | L | T | S | P | L | M | N | P | V | 10 | 5658 |
| 1 | M | I | A | N | T | Y | L | L | T | 9 | 5659 |
| 9 | T | S | P | L | M | N | P | V | I | 8 | S660 |
| 5 | T | Y | L | L | T | S | P | L | M | 7 | 5661 |
| 2 | I | A | N | T | Y | L | L | T | S | 3 | 5662 |
| 3 | A | N | T | Y | L | L | T | S | P | 3 | 5663 |
| 7 | L | L | T | S | P | L | M | N | P | 3 | 5664 |
| 6 | Y | L | L | T | S | P | L | M | N | 2 | 5665 |

HLA-B*08 9-mers v.2 238P1B2

| 4 | N | T | Y | L | L | T | S | P | L | 11 | 5666 |
| 9 | T | S | P | L | M | N | P | V | I | 8 | 5667 |
| 6 | Y | L | L | T | S | P | L | M | N | 6 | 5668 |
| 7 | L | L | T | S | P | L | M | N | P | 6 | 5669 |
| 2 | I | A | N | T | Y | L | L | T | S | 5 | 5670 |
| 1 | M | I | A | N | T | Y | L | L | T | 4 | 5671 |
| 3 | A | N | T | Y | L | L | T | S | P | 1 | 5672 |
| 5 | T | Y | L | L | T | S | P | L | M | 1 | 5673 |

HLA-B*1510 9-mers v.2 238P1B2

| 4 | N | T | Y | L | L | T | S | P | L | 10 | 5674 |
| 5 | T | Y | L | L | T | S | P | L | M | 8 | 5675 |
| 8 | L | T | S | P | L | M | N | P | V | 4 | 5676 |
| 9 | T | S | P | L | M | N | P | V | I | 4 | 5677 |
| 2 | I | A | N | T | Y | L | L | T | S | 3 | 5678 |
| 6 | Y | L | L | T | S | P | L | M | N | 2 | 5679 |
| 1 | M | I | A | N | T | Y | L | L | T | 1 | 5680 |
| 7 | L | L | T | S | P | L | M | N | P | 1 | 5681 |

HLA-B*2705 9-mers v.2 238P1B2

| 4 | N | T | Y | L | L | T | S | P | L | 15 | 5682 |
| 5 | T | Y | L | L | T | S | P | L | M | 13 | 5683 |
| 9 | T | S | P | L | M | N | P | V | I | 10 | 5684 |
| 3 | A | N | T | Y | L | L | T | S | P | 6 | 5685 |
| 7 | L | L | T | S | P | L | M | N | P | 5 | 5686 |
| 2 | I | A | N | T | Y | L | L | T | S | 4 | 5687 |
| 6 | Y | L | L | T | S | P | L | M | N | 4 | 5688 |
| 8 | L | T | S | P | L | M | N | P | V | 3 | 5689 |
| 1 | M | I | A | N | T | Y | L | L | T | 1 | 5690 |

TABLE XIXA-continued part 3

| Pos | 1 | 2 | 3 | 4 | 5 | 6 | 7 | 8 | 9 | score | SEQ ID |
|---|---|---|---|---|---|---|---|---|---|---|---|
| HLA-B*2709 9-mers v.2 238P1B2 | | | | | | | | | | | |
| 4 | N | T | Y | L | L | T | S | P | L | 12 | 5691 |
| 5 | T | Y | L | L | T | S | P | L | M | 11 | 5692 |
| 8 | L | T | S | P | L | M | N | P | V | 9 | 5693 |
| 9 | T | S | P | L | M | N | P | V | I | 9 | 5694 |
| 6 | Y | L | L | T | S | P | L | M | N | 3 | 5695 |
| 7 | L | L | T | S | P | L | M | N | P | 3 | 5696 |
| 2 | I | A | N | T | Y | L | L | T | S | 2 | 5697 |
| 3 | A | N | T | Y | L | L | T | S | P | 2 | 5698 |
| 1 | M | I | A | N | T | Y | L | L | T | 1 | 5699 |
| HLA-B*4402 9-mers v.2 238P1B2 | | | | | | | | | | | |
| 4 | N | T | Y | L | L | T | S | P | L | 13 | 5700 |
| 9 | T | S | P | L | M | N | P | V | I | 11 | 5701 |
| 8 | L | T | S | P | L | M | N | P | V | | 5702 |

TABLE XIXB part 1

| Pos | 1 | 2 | 3 | 4 | 5 | 6 | 7 | 8 | 9 | 0 | score | SEQ ID |
|---|---|---|---|---|---|---|---|---|---|---|---|---|
| HLA-A*0201 10-mers v.1: 238P1B2 | | | | | | | | | | | | |
| 161V | L | I | I | R | T | V | L | S | V | | 30 | 5703 |
| 8R | I | A | Q | I | G | V | A | S | V | | 28 | 5704 |
| 9L | M | L | T | P | M | V | A | L | L | | 28 | 5705 |
| 7I | L | T | D | S | R | I | A | Q | I | | 26 | 5706 |
| 95L | L | M | L | T | P | M | V | A | I | | 26 | 5707 |
| 191A | I | Y | Y | I | P | L | I | S | L | | 26 | 5708 |
| 25S | I | F | W | F | N | V | R | E | I | | 25 | 5709 |
| 152D | L | L | L | I | L | L | S | Y | V | | 25 | 5710 |
| 153L | L | L | I | L | L | S | Y | V | L | | 25 | 5711 |
| 155L | I | L | L | S | Y | V | L | I | I | | 25 | 5712 |
| 223L | L | I | S | P | L | M | N | P | V | | 25 | 5713 |
| 227P | L | M | N | P | V | I | Y | S | V | | 25 | 5714 |
| 6S | M | L | S | A | T | D | L | G | L | | 24 | 5715 |
| 5L | L | A | M | A | F | D | R | F | V | | 24 | 5716 |
| 5A | M | A | F | D | R | F | V | A | V | | 24 | 5717 |
| 154L | L | I | L | L | S | Y | V | L | I | | 24 | 5718 |
| 19Y | I | P | L | I | S | L | S | I | V | | 24 | 5719 |
| 1G | L | S | I | S | T | L | V | T | M | | 23 | 5720 |
| 14A | M | F | S | T | V | G | V | D | L | | 23 | 5721 |
| 4F | L | S | M | L | S | A | T | D | L | | 21 | 5722 |
| 142L | T | A | M | F | S | T | V | G | V | | 21 | 5723 |
| 147S | T | V | G | V | D | L | L | I | L | | 21 | 5724 |
| 186H | I | V | A | F | A | I | Y | Y | I | | 21 | 5725 |
| 22L | I | S | P | L | M | N | P | V | I | | 21 | 5726 |
| 24Q | I | R | R | A | V | I | K | I | L | | 21 | 5727 |
| 11T | D | L | G | L | S | I | S | T | L | | 20 | 5728 |
| 22T | M | L | S | I | F | W | F | N | V | | 20 | 5729 |
| 42H | M | F | F | I | K | F | F | T | V | | 20 | 5730 |
| 97M | L | T | P | M | V | A | L | L | I | | 20 | 5731 |
| 162L | I | I | R | T | V | L | S | V | A | | 20 | 5732 |
| 12D | L | G | L | S | I | S | T | L | V | | 19 | 5733 |
| 107R | L | S | Y | C | H | S | Q | V | L | | 19 | 5734 |
| 12Y | C | Y | H | P | D | V | M | K | L | | 19 | 5735 |
| 148T | V | G | V | D | L | L | I | L | I | | 19 | 5736 |
| 157L | L | S | Y | V | L | I | I | R | T | | 19 | 5737 |
| 158L | S | Y | V | L | I | I | R | T | V | | 19 | 5738 |
| 21T | M | I | A | N | T | Y | L | L | I | | 19 | 5739 |
| 15L | S | I | S | T | L | V | T | M | L | | 18 | 5740 |
| 51V | M | E | S | S | V | L | L | A | M | | 18 | 5741 |
| 156I | L | L | S | Y | V | L | I | I | R | | 18 | 5742 |
| 22Y | L | I | S | P | L | M | N | P | V | | 18 | 5743 |
| 49T | F | V | M | E | S | S | V | L | L | | 17 | 5744 |
| 8I | G | V | A | S | V | I | R | G | L | | 17 | 5745 |
| 87G | V | A | S | V | I | R | G | L | L | | 17 | 5746 |
| 89A | S | V | I | R | G | L | L | M | L | | 17 | 5747 |
| 94G | L | L | M | L | T | P | M | V | A | | 17 | 5748 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 189A | F | A | I | Y | Y | I | P | L | I | | 17 | 5749 |
| 193Y | Y | I | P | L | I | S | L | S | I | | 17 | 5750 |
| 232V | I | Y | S | V | K | T | K | Q | I | | 17 | 5751 |
| 239K | Q | I | R | R | A | V | I | K | I | | 17 | 5752 |
| 50T | V | M | E | S | S | V | L | L | A | | 16 | 5753 |
| 75A | M | I | L | T | D | S | R | I | A | | 16 | 5754 |
| 90S | V | I | R | G | L | L | M | L | T | | 16 | 5755 |
| 133D | T | R | I | N | S | A | V | G | L | | 16 | 5756 |
| 135R | I | N | S | A | V | G | L | T | A | | 16 | 5757 |
| 149V | G | V | D | L | L | I | L | L | | | 16 | 5758 |
| 188V | A | F | A | I | Y | Y | I | P | L | | 16 | 5759 |
| 208K | Q | A | P | A | Y | V | H | T | M | | 16 | 5760 |
| 215H | T | M | I | A | N | T | Y | L | L | | 16 | 5761 |
| 8L | S | A | T | D | L | G | L | S | I | | 15 | 5762 |
| 74Y | A | M | I | L | T | D | S | R | I | | 15 | 5763 |
| 99T | P | M | V | A | L | L | I | R | L | | 15 | 5764 |
| 103A | L | L | I | R | L | S | Y | C | H | | 15 | 5765 |
| 131C | T | D | T | R | I | N | S | A | V | | 15 | 5766 |
| 140V | G | L | T | A | M | F | S | T | V | | 15 | 5767 |
| 196P | L | I | S | L | S | I | V | H | R | | 15 | 5768 |
| 197L | I | S | L | S | I | V | H | R | F | | 15 | 5769 |
| 217M | I | A | N | T | Y | L | L | I | S | | 15 | 5770 |
| 7M | L | S | A | T | D | L | G | L | S | | 14 | 5771 |
| 47K | F | F | T | V | M | E | S | S | V | | 14 | 5772 |
| 68V | S | N | P | L | R | Y | A | M | I | | 14 | 5773 |
| 83I | A | Q | I | G | V | A | S | V | I | | 14 | 5774 |
| 91V | I | R | G | L | L | M | L | T | P | | 14 | 5775 |
| 104L | L | I | R | L | S | Y | C | H | S | | 14 | 5776 |
| 106I | R | L | S | Y | C | H | S | Q | V | | 14 | 5777 |
| 145M | F | S | T | V | G | V | D | L | L | | 14 | 5778 |
| 178E | T | F | S | T | C | V | S | H | I | | 14 | 5779 |
| 219A | N | T | Y | L | L | I | S | P | L | | 14 | 5780 |
| 237K | T | K | Q | I | R | R | A | V | I | | 14 | 5781 |
| 45F | I | K | F | F | T | V | M | E | S | | 13 | 5782 |
| 56V | L | L | A | M | A | F | D | R | F | | 13 | 5783 |
| 66V | A | V | S | N | P | L | R | Y | A | | 13 | 5784 |
| 71P | L | R | Y | A | M | I | L | T | D | | 13 | 5785 |
| 93R | G | L | L | M | L | T | P | M | V | | 13 | 5786 |
| 105L | I | R | L | S | Y | C | H | S | Q | | 13 | 5787 |
| 130S | C | T | D | T | R | I | N | S | A | | 13 | 5788 |
| 163I | R | T | V | L | S | V | A | S | | | 13 | 5789 |
| 167V | L | S | V | A | S | P | E | E | R | | 13 | 5790 |
| 181S | T | C | V | S | H | I | V | A | F | | 13 | 5791 |
| 183C | V | S | H | I | V | A | F | A | I | | 13 | 5792 |
| 199S | I | V | H | R | F | H | R | F | G K | | 13 | 5793 |
| 201S | I | V | H | R | F | C | K | Q | A | | 13 | 5794 |
| 218I | A | N | T | Y | L | L | I | S | P | | 13 | 5795 |
| 228L | M | N | P | V | I | Y | S | V | K | | 13 | 5796 |
| 235S | V | K | T | K | Q | I | R | R | A | | 13 | 5797 |
| 245V | I | K | I | L | H | S | K | E | T | | 13 | 5798 |
| 2Y | Y | F | L | S | M | L | S | A | T | | 12 | 5799 |
| 1A | T | D | L | G | L | S | I | S | T | | 12 | 5800 |
| 17I | S | T | L | V | T | M | L | S | I | | 12 | 5801 |
| 18S | T | L | V | T | M | L | S | I | F | | 12 | 5802 |
| 31V | R | E | I | S | F | N | A | C | L | | 12 | 5803 |
| 37N | A | C | L | S | H | M | F | F | I | | 12 | 5804 |
| 39C | L | S | H | M | F | F | I | K | F | | 12 | 5805 |
| 60M | A | F | D | R | F | V | A | V | S | | 12 | 5806 |
| 67A | V | S | N | P | L | R | Y | A | M | | 12 | 5807 |
| 69S | N | P | L | R | Y | A | M | I | L | | 12 | 5808 |
| 85Q | I | G | V | A | S | V | I | R | G | | 12 | 5809 |
| 115V | L | H | S | Y | C | Y | H | P | | | 12 | 5810 |
| 139A | V | G | L | T | A | M | F | S | T | | 12 | 5811 |
| 159S | Y | V | L | I | I | R | T | V | L | | 12 | 5812 |
| 170V | A | S | P | E | E | R | K | E | T | | 12 | 5813 |
| 205R | F | G | K | Q | A | P | A | Y | V | | 12 | 5814 |
| 209Q | A | P | A | Y | V | H | T | M | I | | 12 | 5815 |
| 212Y | V | H | T | M | I | A | N | T | | | 12 | 5816 |
| 23M | L | S | I | F | W | F | N | V | R | | 11 | 5817 |
| 34I | S | F | N | A | C | L | S | H | M | | 11 | 5818 |
| 58L | A | M | A | F | D | R | F | V | A | | 11 | 5819 |
| 63D | R | F | V | A | V | S | N | P | L | | 11 | 5820 |
| 76M | I | L | T | D | S | R | I | A | Q | | 11 | 5821 |
| 79T | D | S | R | I | A | Q | I | G | V | | 11 | 5822 |
| 98L | T | P | M | V | A | L | L | I | R | | 11 | 5823 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 102 | V | A | L | L | I | R | L | S | Y | C | 11 | 5824 |
| 128 | K | L | S | C | T | D | T | R | I | N | 11 | 5825 |
| 136 | I | N | S | A | V | G | L | T | A | M | 11 | 5826 |
| 146 | F | S | T | V | G | V | D | L | L | L | 11 | 5827 |
| 179 | T | F | S | T | C | V | S | H | I | V | 11 | 5828 |
| 236 | V | K | T | K | Q | I | R | R | A | V | 11 | 5829 |
| 243 | R | A | V | I | K | I | L | H | S | K | 11 | 5830 |
| 9 | S | A | T | D | L | G | L | S | I | S | 10 | 5831 |
| 16 | S | I | S | T | L | V | T | M | L | S | 10 | 5832 |
| 19 | T | L | V | T | M | L | S | I | F | W | 10 | 5833 |
| 48 | F | F | T | V | M | E | S | S | V | L | 10 | 5834 |
| 52 | M | E | S | S | V | L | L | A | M | A | 10 | 5835 |
| 88 | V | A | S | V | I | R | G | L | L | M | 10 | 5836 |
| 92 | I | R | G | L | L | M | L | T | P | M | 10 | 5837 |
| 117 | H | H | S | Y | C | Y | H | P | D | V | 10 | 5838 |
| 126 | V | M | K | L | S | C | T | D | T | R | 10 | 5839 |
| 127 | M | K | L | S | C | T | D | T | R | I | 10 | 5840 |
| 134 | T | R | I | N | S | A | V | G | L | T | 10 | 5841 |
| 141 | G | L | T | A | M | F | S | T | V | G | 10 | 5842 |
| 150 | G | V | D | L | L | L | I | L | L | S | 10 | 5843 |
| 151 | V | D | L | L | L | I | L | L | S | Y | 10 | 5844 |
| 160 | Y | V | L | I | I | R | T | V | L | S | 10 | 5845 |
| 169 | S | V | A | S | P | E | E | R | K | E | 10 | 5846 |
| 182 | T | C | V | S | H | I | V | A | F | A | 10 | 5847 |
| 214 | V | H | T | M | I | A | N | T | Y | L | 10 | 5848 |
| 220 | N | T | Y | L | L | I | S | P | L | M | 10 | 5849 |
| 244 | A | V | I | K | I | L | H | S | K | E | 10 | 5850 |
| 13 | L | G | L | S | I | S | T | L | V | T | 9 | 5851 |
| 20 | L | V | T | M | L | S | I | F | W | F | 9 | 5852 |
| 100 | P | M | V | A | L | L | I | R | L | S | 9 | 58S3 |
| 101 | M | V | A | L | L | I | R | L | S | Y | 9 | 5854 |
| 164 | I | R | T | V | L | S | V | A | S | P | 9 | 5855 |
| 166 | T | V | L | S | V | A | S | P | E | E | 9 | 5856 |
| 213 | Y | V | H | T | M | I | A | N | T | Y | 9 | 5857 |
| 3 | Y | F | L | S | M | L | S | A | T | D | 8 | 5858 |
| 30 | N | V | R | E | I | S | F | N | A | C | 8 | 5859 |
| 55 | S | V | L | L | A | M | A | F | D | R | 8 | 5860 |
| 65 | F | V | A | V | S | N | P | L | R | Y | 8 | 5861 |
| 84 | A | Q | I | G | V | A | S | V | I | R | 8 | 5862 |
| 123 | H | P | D | V | M | K | L | S | C | T | 8 | 5863 |
| 125 | D | V | M | K | L | S | C | T | D | T | 8 | 5864 |
| 138 | S | A | V | G | L | T | A | M | F | S | 8 | 5865 |
| 143 | T | A | M | F | S | T | V | G | V | D | 8 | 5866 |
| 175 | E | R | K | E | T | F | S | T | C | V | 8 | 5867 |
| 187 | I | V | A | F | A | I | Y | Y | I | P | 8 | 5868 |
| 226 | S | P | L | M | N | P | V | I | Y | S | 8 | 5869 |
| 229 | M | N | P | V | I | Y | S | V | K | T | 8 | 5870 |
| 1 | M | Y | Y | F | L | S | M | L | S | A | 7 | 5871 |
| 33 | E | I | S | F | N | A | C | L | S | H | 7 | 5872 |
| 72 | L | R | Y | A | M | I | L | T | D | S | 7 | 5873 |
| 80 | D | S | R | I | A | Q | I | G | V | A | 7 | 5874 |
| 81 | S | R | I | A | Q | I | G | V | A | S | 7 | 5875 |
| 109 | S | Y | C | H | S | Q | V | L | H | H | 7 | 5876 |
| 11 | Y | C | H | S | Q | V | L | H | H | S | 7 | 5877 |
| 190 | F | A | I | Y | Y | I | P | L | I | S | 7 | 5878 |
| 192 | I | Y | Y | I | P | L | I | S | L | S | 7 | 5879 |
| 202 | I | V | H | R | F | G | K | Q | A | P | 7 | 5880 |
| 207 | G | K | Q | A | P | A | Y | V | H | T | 7 | 5881 |
| 210 | A | P | A | Y | V | H | T | M | I | A | 7 | 5882 |
| 242 | R | R | A | V | I | K | I | L | H | S | 7 | 5883 |
| 21 | V | T | M | L | S | I | F | W | F | N | 6 | 5884 |
| 41 | S | H | M | F | F | I | K | F | F | T | 6 | 5885 |
| 61 | A | F | D | R | F | V | A | V | S | N | 6 | 5886 |
| 70 | N | P | L | R | Y | A | M | I | L | T | 6 | 5887 |
| 78 | L | T | D | S | R | I | A | Q | I | G | 6 | 5888 |
| 114 | Q | V | L | H | H | S | Y | C | Y | H | 6 | 5889 |
| 122 | Y | H | P | D | V | M | K | L | S | C | 6 | 5890 |
| 171 | A | S | P | E | E | R | K | E | T | F | 6 | 5891 |
| 200 | L | S | I | V | H | R | F | G | K | Q | 6 | 5892 |
| 203 | V | H | R | F | G | K | Q | A | P | A | 6 | 5893 |
| 24 | L | S | I | W | F | N | V | R | E | I | 5 | 5894 |
| 28 | W | F | N | V | R | E | I | S | F | N | 5 | 5895 |
| 29 | F | N | V | R | E | I | S | F | N | A | 5 | 5896 |
| 40 | L | S | H | M | F | F | I | K | F | F | 5 | 5897 |
| 43 | M | F | F | I | K | F | F | T | V | M | 5 | 5898 |
| 44 | F | F | I | K | F | F | T | V | M | E | 5 | 5899 |
| 108 | L | S | Y | C | H | S | Q | V | L | H | 5 | 5900 |
| 118 | H | S | Y | C | Y | H | P | D | V | M | 5 | 5901 |
| 204 | H | R | F | G | K | Q | A | P | A | Y | 5 | 5902 |
| 230 | N | P | V | I | Y | S | V | K | T | K | 5 | 5903 |
| 27 | F | W | F | N | V | R | E | I | S | F | 4 | 5904 |
| 35 | S | F | N | A | C | L | S | H | M | F | 4 | 5905 |
| 38 | A | C | L | S | H | M | F | F | I | K | 4 | 5906 |
| 46 | I | K | F | F | T | V | M | E | S | S | 4 | 5907 |
| 54 | S | S | V | L | L | A | M | A | F | D | 4 | 5908 |
| 62 | F | D | R | F | V | A | V | S | N | P | 4 | 5909 |
| 73 | R | Y | A | M | I | L | T | D | S | R | 4 | 5910 |
| 137 | N | S | A | V | G | L | T | A | M | F | 4 | 5911 |
| 165 | R | T | V | L | S | V | A | S | P | E | 4 | 5912 |
| 180 | F | S | T | C | V | S | H | I | V | A | 4 | 5913 |
| 185 | S | H | I | V | A | F | A | I | Y | Y | 4 | 5914 |
| 195 | I | P | L | T | S | L | S | I | V | H | 4 | 5915 |
| 198 | I | S | L | S | I | V | H | R | F | G | 4 | 5916 |
| 225 | I | S | P | L | M | N | P | V | I | Y | 4 | 5917 |
| 231 | P | V | I | Y | S | V | K | T | K | Q | 4 | 5918 |
| 5 | L | S | M | L | S | A | T | D | L | G | 3 | 5919 |
| 36 | F | N | A | C | L | S | H | M | F | F | 3 | 5920 |
| 111 | C | H | S | Q | V | L | H | H | S | Y | 3 | 5921 |
| 113 | S | Q | V | L | H | H | S | Y | C | Y | 3 | 5922 |
| 116 | H | H | S | Y | C | Y | H | P | D | V | 3 | 5923 |
| 119 | S | Y | C | Y | H | P | D | V | M | K | 3 | 5924 |
| 172 | S | P | E | E | R | K | H | T | F | S | 3 | 5925 |
| 177 | K | E | T | F | S | T | C | V | S | H | 3 | 5926 |
| 184 | V | S | H | I | V | A | F | A | I | Y | 3 | 5927 |
| 211 | P | A | Y | V | H | T | M | I | A | N | 3 | 5928 |
| 221 | T | Y | L | L | I | S | P | L | M | N | 3 | 5929 |
| 26 | I | F | W | F | N | V | R | E | I | S | 2 | 5930 |
| 32 | R | E | I | S | F | N | A | C | L | S | 2 | 5931 |
| 129 | L | S | C | T | D | T | R | I | N | S | 2 | 5932 |
| 168 | L | S | V | A | S | P | E | E | R | K | 2 | 5933 |
| 173 | P | E | E | R | K | E | T | F | S | T | 2 | 5934 |
| 233 | I | Y | S | V | K | T | K | Q | I | R | 2 | 5935 |
| 234 | Y | S | V | K | T | K | Q | I | R | R | 2 | 5936 |
| 238 | T | K | Q | I | R | R | A | V | I | K | 2 | 5937 |
| 241 | I | R | R | A | V | I | K | I | L | H | 2 | 5938 |
| 64 | F | V | A | V | S | N | P | L | R | Y | 1 | 5939 |
| 121 | C | Y | H | P | D | V | M | K | L | S | 1 | 5940 |
| 132 | T | D | T | R | I | N | S | A | V | G | 1 | 5941 |
| 206 | F | G | K | Q | A | P | A | Y | V | H | 1 | 5942 |
| 124 | P | D | V | M | K | L | S | C | T | D | -1 | 5943 |
| 174 | E | E | R | K | E | T | F | S | T | C | -1 | 5944 |
| 176 | R | K | E | T | F | S | T | C | V | S | -1 | 5945 |
| 53 | E | S | S | V | L | L | A | M | A | F | -2 | 5946 |

HLA-A*0202 10-mers v.1: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 59 | A | M | A | F | D | R | F | V | A | V | 4 | 5947 |
| 189 | A | F | A | I | Y | Y | I | P | L | I | 4 | 5948 |
| 210 | A | P | A | Y | V | H | T | M | I | A | 4 | 5949 |
| 8 | L | S | A | T | D | L | G | L | S | I | 3 | 5950 |
| 36 | F | N | A | C | L | S | H | M | F | F | 3 | 5951 |
| 57 | L | L | A | M | A | F | D | R | F | V | 3 | 5952 |
| 65 | F | V | A | V | S | N | P | L | R | Y | 3 | 5953 |
| 73 | R | Y | A | M | I | L | T | D | S | R | 3 | 5954 |
| 82 | R | I | A | Q | I | G | V | A | S | V | 3 | 5955 |
| 87 | G | V | A | S | V | I | R | G | L | L | 3 | 5956 |
| 101 | M | V | A | L | L | I | R | L | S | Y | 3 | 5957 |
| 137 | N | S | A | V | G | L | T | A | M | F | 3 | 5958 |
| 142 | L | T | A | M | F | S | T | V | G | V | 3 | 5959 |
| 169 | S | V | A | S | P | E | E | R | K | E | 3 | 5960 |
| 187 | I | V | A | F | A | I | Y | Y | I | P | 3 | 5961 |
| 208 | K | Q | A | P | A | Y | V | H | T | M | 3 | 5962 |
| 217 | M | I | A | N | T | Y | L | L | I | S | 3 | 5963 |
| 242 | R | R | A | V | I | K | I | L | H | S | 3 | 5964 |
| 9 | S | A | T | D | L | G | L | S | I | S | 2 | 5965 |
| 37 | N | A | C | L | S | H | M | F | F | I | 2 | 5966 |
| 58 | L | A | M | A | F | D | R | F | V | A | 2 | 5967 |
| 60 | M | A | F | D | R | F | V | A | V | S | 2 | 5968 |
| 66 | V | A | V | S | N | P | L | R | Y | A | 2 | 5969 |
| 74 | Y | A | M | I | L | T | D | S | R | I | 2 | 5970 |

TABLE XIXB-continued part 1

| Pos1 | 2 | 3 | 4 | 5 | 6 | 7 | 8 | 9 | 0 | score | SEQ ID |
|---|---|---|---|---|---|---|---|---|---|---|---|
| 83 I | A | Q | I | G | V | A | S | V | I | 2 | 5971 |
| 88 V | A | S | V | I | R | G | L | L | M | 2 | 5972 |
| 102 V | A | L | L | I | R | L | S | Y | C | 2 | 5973 |
| 138 S | A | V | G | L | T | A | M | F | S | 2 | 5974 |
| 143 T | A | M | F | S | T | V | G | V | D | 2 | 5975 |
| 170 A | S | P | E | E | R | K | E | E | T | 2 | 5976 |
| 188 V | A | F | A | I | Y | Y | I | P | L | 2 | 5977 |
| 190 F | A | I | Y | Y | I | P | L | I | S | 2 | 5978 |
| 209 Q | A | P | A | Y | V | H | T | M | I | 2 | 5979 |
| 211 P | A | Y | V | H | T | M | I | A | N | 2 | 5980 |
| 218 I | A | N | T | Y | L | L | I | S | P | 2 | 5981 |
| 243 R | A | V | I | K | I | L | H | S | K | 2 | 5982 |
| 10 A | T | D | L | G | L | S | I | S | T | 1 | 5983 |
| 38 A | C | L | S | H | M | F | F | I | K | 1 | 5984 |
| 61 A | F | D | R | F | V | A | V | S | N | 1 | 5985 |
| 67 A | V | S | N | P | L | R | Y | A | M | 1 | 5986 |
| 75 A | M | I | L | T | D | S | R | I | A | 1 | 5987 |
| 84 Q | I | G | V | A | S | V | I | R | R | 1 | 5988 |
| 89 A | S | V | I | R | G | L | L | M | L | 1 | 5989 |
| 103 A | L | L | I | R | L | S | Y | C | H | 1 | 5990 |
| 139 A | V | G | L | T | A | M | F | S | L | 1 | 5991 |
| 144 M | F | S | T | V | G | V | D | L | L | 1 | 5992 |
| 171 A | S | P | E | E | R | K | E | T | F | 1 | 5993 |
| 191 A | I | Y | Y | I | P | L | I | S | L | 1 | 5994 |
| 212 Y | V | H | T | M | I | A | N | T | I | 1 | 5995 |
| 219 A | N | T | Y | L | L | I | S | P | L | 1 | 5996 |
| 244 V | I | K | I | L | H | S | K | E | E | 1 | 5997 |

HLA-A*0203 10-mers v.1: 238P1B2

| Pos1 | 2 | 3 | 4 | 5 | 6 | 7 | 8 | 9 | 0 | score | SEQ ID |
|---|---|---|---|---|---|---|---|---|---|---|---|
| 52 M | E | S | S | V | L | L | A | M | A | 18 | 5998 |
| 182 T | C | V | S | H | I | V | A | F | A | 18 | 5999 |
| 203 V | H | R | F | G | K | Q | A | P | A | 18 | 6000 |
| 1 M | Y | F | L | S | M | L | S | A | A | 10 | 6001 |
| 29 F | N | V | R | E | I | S | F | N | A | 10 | 6002 |
| 50 T | V | M | E | S | S | V | L | L | A | 10 | 6003 |
| 58 L | A | M | A | F | D | R | F | V | A | 10 | 6004 |
| 66 V | A | V | S | N | P | L | R | Y | A | 10 | 6005 |
| 75 A | M | I | L | T | D | S | R | I | A | 10 | 6006 |
| 80 D | S | R | I | A | Q | I | G | V | A | 10 | 6007 |
| 94 L | L | M | L | T | P | M | V | A | L | 10 | 6008 |
| 130 S | C | T | D | T | R | I | N | S | A | 10 | 6009 |
| 135 R | I | N | S | A | V | G | L | T | A | 10 | 6010 |
| 162 L | I | I | R | T | V | L | S | V | A | 10 | 6011 |
| 180 F | S | T | C | V | S | H | I | V | A | 10 | 6012 |
| 201 S | I | V | H | R | F | G | K | Q | A | 10 | 6013 |
| 210 A | P | A | Y | V | H | T | M | I | A | 10 | 6014 |
| 235 S | V | K | T | K | Q | I | R | R | A | 10 | 6015 |
| 2 Y | Y | F | L | S | M | L | S | A | T | 9 | 6016 |
| 30 N | V | R | E | I | S | F | N | A | C | 9 | 6017 |
| 51 V | M | E | S | S | V | L | L | A | M | 9 | 6018 |
| 53 E | S | S | V | L | L | A | M | A | F | 9 | 6019 |
| 59 A | M | A | F | D | R | F | V | A | V | 9 | 6020 |
| 67 A | V | S | N | P | L | R | Y | A | M | 9 | 6021 |
| 76 M | I | L | T | D | S | R | I | A | Q | 9 | 6022 |
| 81 S | R | I | A | Q | I | G | V | A | S | 9 | 6023 |
| 95 L | L | M | L | T | P | M | V | A | L | 9 | 6024 |
| 131 C | T | D | T | R | I | N | S | A | V | 9 | 6025 |
| 136 I | N | S | A | V | G | L | T | A | M | 9 | 6026 |
| 163 I | I | R | T | V | L | S | V | A | S | 9 | 6027 |
| 181 S | T | C | V | S | H | I | V | A | F | 9 | 6028 |
| 183 C | V | S | H | I | V | A | F | A | I | 9 | 6029 |
| 202 I | V | H | R | F | G | K | Q | A | P | 9 | 6030 |
| 204 H | R | F | G | K | Q | A | P | A | Y | 9 | 6031 |
| 211 P | A | Y | V | H | T | M | I | A | N | 9 | 6032 |
| 236 K | T | K | Q | I | R | R | A | V | A | 9 | 6033 |
| 3 Y | F | L | S | M | L | S | A | T | D | 8 | 6034 |
| 31 V | R | E | I | S | F | N | A | C | L | 8 | 6035 |
| 54 S | S | V | L | L | A | M | A | F | D | 8 | 6036 |
| 60 M | A | F | D | R | F | V | A | V | S | 8 | 6037 |
| 68 V | S | N | P | L | R | Y | A | M | I | 8 | 6038 |
| 77 L | T | D | S | R | I | A | Q | I | G | 8 | 6039 |
| 82 R | I | A | Q | I | G | V | A | S | V | 8 | 6040 |
| 96 L | M | L | T | P | M | V | A | L | L | 8 | 6041 |
| 132 T | D | T | R | I | N | S | A | V | G | 8 | 6042 |
| 137 N | S | A | V | G | L | T | A | M | F | 8 | 6043 |
| 164 I | R | T | V | L | S | V | A | S | P | 8 | 6044 |
| 184 V | S | H | I | V | A | F | A | I | Y | 8 | 6045 |
| 205 R | F | G | K | Q | A | P | A | Y | V | 8 | 6046 |
| 212 A | Y | V | H | T | M | I | A | N | T | 8 | 6047 |
| 237 K | T | K | Q | I | R | R | A | V | I | 8 | 6048 |

HLA-A1 10-mers v.1: 238P1B2

| Pos1 | 2 | 3 | 4 | 5 | 6 | 7 | 8 | 9 | 0 | score | SEQ ID |
|---|---|---|---|---|---|---|---|---|---|---|---|
| 184 V | S | H | I | V | A | F | A | I | Y | 23 | 6049 |
| 65 F | V | A | V | S | N | P | L | R | Y | 22 | 6050 |
| 101 M | V | A | L | L | I | R | L | S | Y | 22 | 6051 |
| 151 V | D | L | L | L | I | L | L | S | Y | 22 | 6052 |
| 10 A | T | D | L | G | L | S | I | S | T | 21 | 6053 |
| 185 S | H | I | V | A | F | A | I | A | Y | 21 | 6054 |
| 225 I | S | P | L | M | N | P | V | I | Y | 19 | 6055 |
| 150 G | V | D | L | L | L | I | L | L | S | 18 | 6056 |
| 51 V | M | E | S | S | V | L | L | A | M | 17 | 6057 |
| 113 S | Q | V | L | H | H | S | Y | C | Y | 17 | 6058 |
| 131 C | T | D | T | R | I | N | S | A | V | 17 | 6059 |
| 147 S | T | V | G | V | D | L | L | L | I | 17 | 6060 |
| 213 Y | V | H | T | M | I | A | N | T | Y | 17 | 6061 |
| 78 L | T | D | S | R | I | A | Q | I | G | 16 | 6062 |
| 204 H | R | F | G | K | Q | A | P | A | Y | 16 | 6063 |
| 111 M | H | S | Q | V | L | H | H | S | Y | 15 | 6064 |
| 97 M | L | T | P | M | V | A | L | L | I | 13 | 6065 |
| 146 F | S | T | V | G | V | D | L | L | L | 13 | 6066 |
| 31 V | R | E | I | S | F | N | A | C | L | 12 | 6067 |
| 89 A | S | V | I | R | G | L | L | M | L | 12 | 6068 |
| 98 L | T | P | M | V | A | L | L | I | R | 12 | 6069 |
| 172 S | P | E | E | R | K | E | T | F | S | 12 | 6070 |
| 193 Y | Y | I | P | L | I | S | L | S | I | 12 | 6071 |
| 8 L | S | A | T | D | L | G | L | S | I | 11 | 6072 |
| 61 A | F | D | R | F | V | A | V | S | N | 11 | 6073 |
| 176 R | K | E | T | F | S | T | C | V | S | 11 | 6074 |
| 17 I | S | T | L | V | T | M | L | S | I | 10 | 6075 |
| 21 V | T | M | L | S | I | F | W | F | N | 10 | 6076 |
| 39 C | L | S | H | M | F | F | I | K | F | 10 | 6077 |
| 68 V | S | N | P | L | R | Y | A | M | I | 10 | 6078 |
| 88 V | A | S | V | I | R | G | L | L | M | 10 | 6079 |
| 123 M | P | D | V | M | K | L | S | C | T | 10 | 6080 |
| 173 P | E | E | R | K | H | T | F | S | T | 10 | 6081 |
| 180 F | S | T | C | V | S | H | I | V | A | 10 | 6082 |
| 234 Y | S | V | K | T | K | Q | I | R | R | 10 | 6083 |
| 49 T | V | M | E | S | S | V | L | L | L | 9 | 6084 |
| 50 T | V | M | E | S | S | V | L | L | A | 9 | 6085 |
| 109 S | Y | C | H | S | Q | V | L | H | H | 9 | 6086 |
| 129 L | S | C | T | D | T | R | I | N | S | 9 | 6087 |
| 161 V | L | I | I | R | T | V | L | S | V | 9 | 6088 |
| 200 L | S | I | V | H | R | F | G | K | Q | 9 | 6089 |
| 6 S | M | L | S | A | T | D | L | G | L | 8 | 6090 |
| 18 S | T | L | V | T | M | L | S | I | F | 8 | 6091 |
| 91 V | I | R | G | L | L | M | L | T | P | 8 | 6092 |
| 122 Y | H | P | D | V | M | K | L | S | C | 8 | 6093 |
| 181 S | T | C | V | S | H | I | V | A | F | 8 | 6094 |
| 215 H | T | M | I | A | N | T | Y | L | L | 8 | 6095 |
| 216 T | M | I | A | N | T | Y | L | L | I | 8 | 6096 |
| 220 N | T | Y | L | L | I | S | P | L | M | 8 | 6097 |
| 237 K | T | K | Q | I | R | R | A | V | I | 8 | 6098 |
| 13 L | G | L | S | I | S | T | L | V | T | 7 | 6099 |
| 71 P | L | R | Y | A | M | I | L | T | D | 7 | 6100 |
| 135 R | I | N | S | A | V | G | L | T | A | 7 | 6101 |
| 149 V | G | V | D | L | L | L | I | L | L | 7 | 6102 |
| 155 L | I | L | L | S | Y | V | L | I | I | 7 | 6103 |
| 178 E | T | F | S | T | C | V | S | H | I | 7 | 6104 |
| 190 F | A | I | Y | Y | I | P | L | I | S | 7 | 6105 |
| 221 T | Y | L | L | I | S | P | L | M | N | 7 | 6106 |
| 226 S | P | L | M | N | P | V | I | Y | S | 7 | 6107 |
| 239 K | Q | I | R | R | A | V | I | K | I | 7 | 6108 |
| 1 M | Y | F | L | S | M | L | S | A | A | 6 | 6109 |
| 5 S | M | L | S | A | T | D | L | G | L | 6 | 6110 |
| 15 L | S | I | S | T | L | V | T | M | L | 6 | 6111 |
| 33 E | I | S | F | N | A | C | L | S | H | 6 | 6112 |
| 54 S | S | V | L | L | A | M | A | F | D | 6 | 6113 |
| 70 N | P | L | R | Y | A | M | I | L | T | 6 | 6114 |

TABLE XIXB-continued part 1

| Pos1 | 2 | 3 | 4 | 5 | 6 | 7 | 8 | 9 | 0 | score | SEQ ID |
|---|---|---|---|---|---|---|---|---|---|---|---|
| 108L | S | Y | C | H | S | Q | V | L | H | 6 | 6115 |
| 121C | Y | H | P | D | V | M | K | L | S | 6 | 6116 |
| 133D | T | R | I | N | S | A | V | G | L | 6 | 6117 |
| 142L | T | A | M | F | S | T | V | G | V | 6 | 6118 |
| 148T | V | G | V | D | L | L | L | I | L | 6 | 6119 |
| 165R | T | V | L | S | V | A | S | P | E | 6 | 6120 |
| 170V | A | S | P | E | E | R | K | E | T | 6 | 6121 |
| 217M | I | A | N | T | Y | L | L | I | S | 6 | 6122 |
| 224L | I | S | P | L | M | N | P | V | I | 6 | 6123 |
| 241I | R | R | A | V | I | K | I | L | H | 6 | 6124 |
| 242R | R | A | V | I | K | I | L | H | S | 6 | 6125 |
| 19T | L | V | T | M | L | S | I | F | W | 5 | 6126 |
| 23M | L | S | I | F | W | F | N | V | R | 5 | 6127 |
| 24L | S | I | F | W | F | N | V | R | E | 5 | 6128 |
| 27F | W | F | N | V | R | E | I | S | F | 5 | 6129 |
| 56V | L | A | M | A | F | D | R | F | V | 5 | 6130 |
| 76M | I | L | T | D | S | R | I | A | Q | 5 | 6131 |
| 80D | S | R | I | A | Q | I | G | V | A | 5 | 6132 |
| 85Q | I | G | V | A | S | V | I | R | G | 5 | 6133 |
| 118H | S | Y | C | Y | H | P | D | V | M | 5 | 6134 |
| 120Y | C | Y | H | P | D | V | M | K | L | 5 | 6135 |
| 137N | S | A | V | G | L | T | A | M | F | 5 | 6136 |
| 156I | L | L | S | Y | V | L | I | I | R | 5 | 6137 |
| 157L | L | S | Y | V | L | I | I | R | T | 5 | 6138 |
| 171A | S | P | E | E | R | K | E | T | F | 5 | 6139 |
| 188V | A | F | A | I | Y | Y | I | P | L | 5 | 6140 |
| 191A | I | Y | Y | I | P | L | I | S | L | 5 | 6141 |
| 195I | P | L | I | S | L | S | I | V | H | 5 | 6142 |
| 208K | Q | A | P | A | Y | V | H | T | M | 5 | 6143 |
| 228L | M | N | P | V | I | Y | S | V | K | 5 | 6144 |
| 16S | I | S | T | L | V | T | M | L | S | 4 | 6145 |
| 34I | S | F | N | A | C | L | S | H | M | 4 | 6146 |
| 38A | C | L | S | H | M | F | F | I | K | 4 | 6147 |
| 40L | S | H | M | F | F | I | K | F | F | 4 | 6148 |
| 43M | F | F | I | K | F | F | T | V | M | 4 | 6149 |
| 53E | S | S | V | L | L | A | M | A | F | 4 | 6150 |
| 59M | A | F | D | R | F | V | A | V | S | 4 | 6151 |
| 79T | D | S | R | I | A | Q | I | G | V | 4 | 6152 |
| 90S | V | I | R | G | L | L | M | L | T | 4 | 6153 |
| 99T | P | M | V | A | L | L | I | R | L | 4 | 6154 |
| 112H | S | Q | V | L | H | H | S | Y | C | 4 | 6155 |
| 140V | G | L | T | A | M | F | S | T | V | 4 | 6156 |
| 158L | S | Y | V | L | I | I | R | T | V | 4 | 6157 |
| 159S | Y | V | L | I | I | R | T | V | L | 4 | 6158 |
| 160Y | V | L | I | I | R | T | V | L | S | 4 | 6159 |
| 168L | S | V | A | S | P | E | E | R | K | 4 | 6160 |
| 169S | V | A | S | P | E | E | R | K | E | 4 | 6161 |
| 198I | S | L | S | I | V | H | R | F | G | 4 | 6162 |
| 199S | L | S | I | V | H | R | F | G | K | 4 | 6163 |
| 211P | A | Y | V | H | T | M | I | A | N | 4 | 6164 |
| 218I | A | N | T | Y | L | L | I | S | P | 4 | 6165 |
| 7M | L | S | A | T | D | L | G | L | S | 3 | 6166 |
| 12D | L | G | L | S | I | S | T | L | V | 3 | 6167 |
| 25S | I | F | W | F | N | V | R | E | I | 3 | 6168 |
| 30N | V | R | E | I | S | F | N | A | C | 3 | 6169 |
| 35S | F | N | A | C | L | S | H | M | F | 3 | 6170 |
| 42H | M | F | F | I | K | F | F | T | V | 3 | 6171 |
| 64R | F | V | A | V | S | N | P | L | R | 3 | 6172 |
| 81S | R | I | A | Q | I | G | V | A | S | 3 | 6173 |
| 87G | V | A | S | V | I | R | G | L | L | 3 | 6174 |
| 96L | M | L | T | P | M | V | A | L | L | 3 | 6175 |
| 119Y | C | Y | H | P | D | V | M | K | L | 3 | 6176 |
| 134T | R | I | N | S | A | V | G | L | T | 3 | 6177 |
| 138S | A | V | G | L | T | A | M | F | S | 3 | 6178 |
| 145M | F | S | T | V | G | V | D | L | L | 3 | 6179 |
| 154L | L | I | L | L | S | Y | V | L | I | 3 | 6180 |
| 174E | E | R | K | E | T | F | S | T | C | 3 | 6181 |
| 189A | F | A | I | Y | Y | I | P | L | I | 3 | 6182 |
| 201S | I | V | H | R | F | G | K | Q | A | 3 | 6183 |
| 222Y | L | L | I | S | P | L | M | N | P | 3 | 6184 |
| 244A | V | I | K | I | L | H | S | K | E | 3 | 6185 |
| 2Y | Y | F | L | S | M | L | S | A | T | 2 | 6186 |
| 3Y | F | L | S | M | L | S | A | T | D | 2 | 6187 |
| 4F | L | S | M | L | S | A | T | D | L | 2 | 6188 |
| 9S | A | T | D | L | G | L | S | I | S | 2 | 6189 |
| 32R | E | I | S | F | N | A | C | L | S | 2 | 6190 |
| 41S | H | M | F | F | I | K | F | F | T | 2 | 6191 |
| 44F | F | I | K | F | F | T | V | M | E | 2 | 6192 |
| 45F | I | K | F | F | T | V | M | E | S | 2 | 6193 |
| 48F | F | T | V | M | E | S | S | V | L | 2 | 6194 |
| 55S | V | L | L | A | M | A | F | D | R | 2 | 6195 |
| 58L | A | M | A | F | D | R | F | V | A | 2 | 6196 |
| 60M | A | F | D | R | F | V | A | V | S | 2 | 6197 |
| 62F | D | R | F | V | A | V | S | N | P | 2 | 6198 |
| 67A | V | S | N | P | L | R | Y | A | M | 2 | 6199 |
| 69S | N | P | L | R | Y | A | M | I | L | 2 | 6200 |
| 74Y | A | M | I | L | T | D | S | R | I | 2 | 6201 |
| 84A | Q | I | G | V | A | S | V | I | R | 2 | 6202 |
| 94G | L | L | M | L | T | P | M | V | A | 2 | 6203 |
| 100P | M | V | A | L | L | I | R | L | S | 2 | 6204 |
| 103A | L | L | I | R | L | S | Y | C | H | 2 | 6205 |
| 107R | L | S | Y | C | H | S | Q | V | L | 2 | 6206 |
| 110Y | C | H | S | Q | V | L | H | H | S | 2 | 6207 |
| 115V | L | H | H | S | Y | C | Y | H | P | 2 | 6208 |
| 130S | C | T | D | T | R | I | N | S | A | 2 | 6209 |
| 141G | L | T | A | M | F | S | T | V | G | 2 | 6210 |
| 143T | A | M | F | S | T | V | G | V | D | 2 | 6211 |
| 144A | M | F | S | T | V | G | V | D | L | 2 | 6212 |
| 153L | L | I | L | L | S | Y | V | L | 2 | 6213 |
| 167V | S | V | A | S | P | E | E | R | 2 | 6214 |
| 192I | Y | Y | I | P | L | I | S | L | S | 2 | 6215 |
| 194Y | I | P | L | I | S | L | S | I | V | 2 | 6216 |
| 206F | G | K | Q | A | P | A | Y | V | H | 2 | 6217 |
| 214V | H | T | M | I | A | N | T | Y | L | 2 | 6218 |
| 229M | N | P | V | I | Y | S | V | K | T | 2 | 6219 |
| 231P | V | I | Y | S | V | K | T | K | Q | 2 | 6220 |
| 235S | V | K | T | K | Q | I | R | R | A | 2 | 6221 |
| 236V | K | T | K | Q | I | R | R | A | V | 2 | 6222 |
| 11T | D | L | G | L | S | I | S | T | L | 1 | 6223 |
| 14G | L | S | I | S | T | L | V | T | M | 1 | 6224 |
| 26I | F | W | F | N | V | R | E | I | S | 1 | 6225 |
| 29F | N | V | R | E | I | S | F | N | A | 1 | 6226 |
| 36F | N | A | C | L | S | H | M | F | F | 1 | 6227 |
| 52M | E | S | S | V | L | L | A | M | A | 1 | 6228 |
| 57L | L | A | M | A | F | D | R | F | V | 1 | 6229 |
| 66A | V | S | N | P | L | R | Y | A | M | 1 | 6230 |
| 75A | M | I | L | T | D | S | R | I | A | 1 | 6231 |
| 77I | L | T | D | S | R | I | A | Q | I | 1 | 6232 |
| 82R | I | A | Q | I | G | V | A | S | V | 1 | 6233 |
| 83A | Q | I | G | V | A | S | V | I | 1 | 6234 |
| 93G | L | L | M | L | T | P | M | V | 1 | 6235 |
| 95L | L | M | L | T | P | M | V | A | L | 1 | 6236 |
| 102V | A | L | L | I | R | L | S | Y | C | 1 | 6237 |
| 104L | L | I | R | L | S | Y | C | H | S | 1 | 6238 |
| 126V | M | K | L | S | C | T | D | T | R | 1 | 6239 |
| 128K | L | S | C | T | D | T | R | I | N | 1 | 6240 |
| 132T | D | T | R | I | N | S | A | V | G | 1 | 6241 |
| 139A | V | G | L | T | A | M | F | S | T | 1 | 6242 |
| 152D | L | L | I | L | L | S | Y | V | 1 | 6243 |
| 162L | I | I | R | T | V | L | S | V | A | 1 | 6244 |
| 164I | R | T | V | L | S | V | A | S | P | 1 | 6245 |
| 182T | C | V | S | H | I | V | A | F | A | 1 | 6246 |
| 196P | L | I | S | L | S | I | V | H | R | 1 | 6247 |
| 197L | I | S | L | S | I | V | H | R | F | 1 | 6248 |
| 203V | H | R | F | G | K | Q | A | P | A | 1 | 6249 |
| 209Q | A | P | A | Y | V | H | T | M | I | 1 | 6250 |
| 210A | P | A | Y | V | H | T | M | I | A | 1 | 6251 |
| 212A | Y | V | H | T | M | I | A | N | T | 1 | 6252 |
| 219A | N | T | Y | L | L | I | S | P | L | 1 | 6253 |
| 223L | L | I | S | P | L | M | N | P | V | 1 | 6254 |
| 227P | L | M | N | P | V | I | Y | S | V | 1 | 6255 |
| 230N | P | V | I | Y | S | V | K | T | K | 1 | 6256 |
| 232V | I | Y | S | V | K | T | K | Q | I | 1 | 6257 |
| 245V | I | K | I | L | H | S | K | E | T | 1 | 6258 |

HLA-A26 10-mers v.1: 238P1B2

| Pos1 | 2 | 3 | 4 | 5 | 6 | 7 | 8 | 9 | 0 | score | SEQ ID |
|---|---|---|---|---|---|---|---|---|---|---|---|
| 133D | T | R | I | N | S | A | V | G | L | 26 | 6259 |
| 181S | T | C | V | S | H | I | V | A | F | 26 | 6260 |
| 18S | T | L | V | T | M | L | S | I | F | 25 | 6261 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 178 | E | T | F | S | T | C | V | S | H | I | 25 | 6262 |
| 197 | L | I | S | L | S | I | V | H | R | F | 25 | 6263 |
| 20 | L | V | T | M | L | S | I | F | W | F | 24 | 6264 |
| 39 | C | L | S | H | M | F | F | I | K | F | 23 | 6265 |
| 56 | V | L | L | A | M | A | F | D | R | F | 23 | 6266 |
| 191 | A | I | Y | Y | I | P | L | I | S | L | 23 | 6267 |
| 65 | F | V | A | V | S | N | P | L | R | Y | 22 | 6268 |
| 95 | L | L | M | L | T | P | M | V | A | L | 22 | 6269 |
| 101 | M | V | A | L | L | I | R | L | S | Y | 22 | 6270 |
| 148 | T | V | G | V | D | L | L | L | I | L | 22 | 6271 |
| 240 | Q | I | R | R | A | V | I | K | I | L | 22 | 6272 |
| 14 | G | L | S | I | S | T | L | V | T | M | 21 | 6273 |
| 43 | M | F | F | I | K | F | F | T | V | M | 20 | 6274 |
| 87 | G | V | A | S | V | I | R | G | L | L | 20 | 6275 |
| 213 | Y | V | H | T | M | I | A | N | T | Y | 20 | 6276 |
| 49 | F | T | V | M | E | S | S | V | L | L | 19 | 6277 |
| 67 | A | V | S | N | P | L | R | Y | A | M | 19 | 6278 |
| 152 | D | L | L | L | I | L | L | S | Y | V | 19 | 6279 |
| 220 | N | T | Y | L | L | I | S | P | L | M | 19 | 6280 |
| 53 | E | S | S | V | L | L | A | M | A | F | 18 | 6281 |
| 82 | R | I | A | Q | I | G | V | A | S | V | 18 | 6282 |
| 145 | M | F | S | T | V | G | V | D | L | L | 18 | 6283 |
| 215 | H | T | M | I | A | N | T | Y | L | L | 18 | 6284 |
| 25 | S | I | F | W | F | N | V | R | E | I | 17 | 6285 |
| 30 | N | V | R | E | I | S | F | N | A | C | 17 | 6286 |
| 33 | E | I | S | F | N | A | C | L | S | H | 17 | 6287 |
| 35 | S | F | N | A | C | L | S | H | M | F | 17 | 6288 |
| 45 | F | I | K | F | F | T | V | M | E | S | 17 | 6289 |
| 90 | S | V | I | R | G | L | L | M | L | T | 17 | 6290 |
| 107 | R | L | S | Y | C | H | S | Q | V | L | 17 | 6291 |
| 125 | D | V | M | K | L | S | C | T | D | T | 17 | 6292 |
| 162 | L | I | I | R | T | V | L | S | V | A | 17 | 6293 |
| 196 | P | L | I | S | L | S | I | V | H | R | 17 | 6294 |
| 4 | F | L | S | M | L | S | A | T | D | L | 16 | 6295 |
| 15 | L | S | I | S | T | L | V | T | M | L | 16 | 6296 |
| 34 | I | S | F | N | A | C | L | S | H | M | 16 | 6297 |
| 50 | T | V | M | E | S | S | V | L | L | A | 16 | 6298 |
| 63 | D | R | F | V | A | V | S | N | P | L | 16 | 6299 |
| 91 | V | I | R | G | L | L | M | L | T | P | 16 | 6300 |
| 147 | S | T | V | G | V | D | L | L | L | I | 16 | 6301 |
| 153 | L | L | L | I | L | L | S | Y | V | L | 16 | 6302 |
| 194 | Y | I | P | L | I | S | L | S | I | V | 16 | 6303 |
| 204 | H | R | F | G | K | Q | A | P | A | Y | 16 | 6304 |
| 235 | S | V | K | T | K | Q | I | R | R | A | 16 | 6305 |
| 11 | T | D | L | G | L | S | I | S | T | L | 15 | 6306 |
| 48 | F | F | T | V | M | E | S | S | V | L | 15 | 6307 |
| 77 | I | L | T | D | S | R | I | A | Q | I | 15 | 6308 |
| 85 | Q | I | G | V | A | S | V | I | R | G | 15 | 6309 |
| 98 | L | T | P | M | V | A | L | L | I | R | 15 | 6310 |
| 104 | L | L | I | R | L | S | Y | C | H | S | 15 | 6311 |
| 139 | A | V | G | L | T | A | M | F | S | T | 15 | 6312 |
| 150 | G | V | D | L | L | L | I | L | L | S | 15 | 6313 |
| 151 | V | D | L | L | L | I | L | L | S | Y | 15 | 6314 |
| 154 | L | L | L | I | L | L | S | Y | V | L | 15 | 6315 |
| 161 | V | L | I | I | R | T | V | L | S | V | 15 | 6316 |
| 184 | V | S | H | I | V | A | F | A | I | Y | 15 | 6317 |
| 187 | I | V | A | F | A | I | Y | Y | I | P | 15 | 6318 |
| 208 | K | Q | A | P | A | Y | H | T | M | I | 15 | 6319 |
| 217 | M | I | A | N | T | Y | L | L | I | S | 15 | 6320 |
| 223 | L | L | I | S | P | L | M | N | P | V | 15 | 6321 |
| 244 | A | V | I | K | I | L | H | S | K | E | 15 | 6322 |
| 12 | D | L | G | L | S | I | S | T | L | V | 14 | 6323 |
| 21 | V | T | M | L | S | I | F | W | F | N | 14 | 6324 |
| 40 | L | S | H | M | F | F | I | K | F | F | 14 | 6325 |
| 51 | V | M | E | S | S | V | L | L | A | M | 14 | 6326 |
| 114 | Q | V | L | H | H | S | Y | C | Y | H | 14 | 6327 |
| 120 | Y | C | Y | H | P | D | V | M | K | L | 14 | 6328 |
| 155 | L | I | L | L | S | Y | V | L | I | I | 14 | 6329 |
| 186 | H | I | V | A | F | A | I | Y | Y | I | 14 | 6330 |
| 188 | V | A | F | A | I | Y | Y | I | P | L | 14 | 6331 |
| 222 | Y | L | L | I | S | P | L | M | N | P | 14 | 6332 |
| 27 | F | W | F | N | V | R | E | I | S | F | 13 | 6333 |
| 78 | L | T | D | S | R | I | A | Q | I | G | 13 | 6334 |
| 86 | I | G | V | A | S | V | I | R | G | L | 13 | 6335 |
| 89 | A | S | V | I | R | G | L | L | M | L | 13 | 6336 |
| 96 | L | M | L | T | P | M | V | A | L | L | 13 | 6337 |
| 99 | T | P | M | V | A | L | L | I | R | L | 13 | 6338 |
| 131 | C | T | D | T | R | I | N | S | A | V | 13 | 6339 |
| 136 | I | N | S | A | V | G | L | T | A | M | 13 | 6340 |
| 137 | N | S | A | V | G | L | T | A | M | F | 13 | 6341 |
| 142 | L | T | A | M | F | S | T | V | G | V | 13 | 6342 |
| 149 | V | G | V | D | L | L | L | I | L | L | 13 | 6343 |
| 156 | I | L | L | S | Y | V | L | I | I | R | 13 | 6344 |
| 157 | L | L | S | Y | V | L | I | I | R | T | 13 | 6345 |
| 166 | T | V | L | S | V | A | S | P | E | E | 13 | 6346 |
| 169 | S | V | A | S | P | E | E | R | K | E | 13 | 6347 |
| 171 | A | S | P | E | E | R | K | E | T | F | 13 | 6348 |
| 219 | A | N | T | Y | L | L | I | S | P | L | 13 | 6349 |
| 224 | L | I | S | P | L | M | N | P | V | I | 13 | 6350 |
| 227 | P | L | M | N | P | V | I | Y | S | V | 13 | 6351 |
| 231 | P | V | I | Y | S | V | K | T | K | Q | 13 | 6352 |
| 237 | K | T | K | Q | I | R | R | A | V | I | 13 | 6353 |
| 7 | M | L | S | A | T | D | L | G | L | S | 12 | 6354 |
| 10 | A | T | D | L | G | L | S | I | S | T | 12 | 6355 |
| 23 | M | L | S | I | F | W | F | N | V | R | 12 | 6356 |
| 36 | F | N | A | C | L | S | H | M | F | F | 12 | 6357 |
| 71 | P | L | R | Y | A | M | I | L | T | D | 12 | 6358 |
| 92 | I | R | G | L | L | M | L | T | P | M | 12 | 6359 |
| 111 | C | H | S | Q | V | L | H | H | S | Y | 12 | 6360 |
| 144 | A | M | F | S | T | V | G | V | D | L | 12 | 6361 |
| 163 | I | I | R | T | V | L | S | V | A | S | 12 | 6362 |
| 174 | E | E | R | K | E | T | F | S | T | C | 12 | 6363 |
| 185 | S | H | I | V | A | F | A | I | Y | Y | 12 | 6364 |
| 189 | A | F | A | I | Y | Y | I | P | L | I | 12 | 6365 |
| 202 | I | V | H | R | F | G | K | Q | A | P | 12 | 6366 |
| 225 | I | S | P | L | M | N | P | V | I | Y | 12 | 6367 |
| 232 | V | I | Y | S | V | K | T | K | Q | I | 12 | 6368 |
| 245 | V | I | K | I | L | H | S | K | E | T | 12 | 6369 |
| 16 | S | I | S | T | L | V | T | M | L | S | 11 | 6370 |
| 28 | W | F | N | V | R | E | I | S | F | N | 11 | 6371 |
| 44 | F | F | I | K | F | F | T | V | M | E | 11 | 6372 |
| 76 | M | I | L | T | D | S | R | I | A | Q | 11 | 6373 |
| 105 | L | I | R | L | S | Y | C | H | S | Q | 11 | 6374 |
| 135 | R | I | N | S | A | V | G | L | T | A | 11 | 6375 |
| 160 | Y | V | L | I | I | R | T | V | L | S | 11 | 6376 |
| 165 | S | V | A | S | P | E | 11 | 6377 |
| 183 | C | V | S | H | I | V | A | F | A | I | 11 | 6378 |
| 201 | S | I | V | H | R | F | G | K | Q | A | 11 | 6379 |
| 6 | S | M | L | S | A | T | D | L | G | L | 10 | 6380 |
| 47 | K | F | F | T | V | M | E | S | S | V | 10 | 6381 |
| 55 | S | V | L | L | A | M | A | F | D | R | 10 | 6382 |
| 69 | S | N | P | L | R | Y | A | M | I | L | 10 | 6383 |
| 80 | D | S | R | I | A | Q | I | G | V | A | 10 | 6384 |
| 97 | M | L | T | P | M | V | A | L | L | I | 10 | 6385 |
| 113 | S | Q | V | L | H | H | S | Y | C | Y | 10 | 6386 |
| 31 | V | R | E | I | S | F | N | A | C | L | 9 | 6387 |
| 57 | L | L | A | M | A | F | D | R | F | V | 9 | 6388 |
| 61 | A | F | D | R | F | V | A | V | S | N | 9 | 6389 |
| 94 | G | L | L | M | L | T | P | M | V | A | 9 | 6390 |
| 115 | V | L | H | H | S | Y | C | Y | H | P | 9 | 6391 |
| 167 | V | L | S | V | A | S | P | E | E | R | 9 | 6392 |
| 175 | E | R | K | E | T | F | S | T | C | V | 9 | 6393 |
| 199 | S | L | S | I | V | H | R | F | G | K | 9 | 6394 |
| 2 | Y | Y | F | L | S | M | L | S | A | T | 8 | 6395 |
| 3 | Y | F | L | S | M | L | S | A | T | D | 8 | 6396 |
| 19 | T | L | V | T | M | L | S | I | F | W | 8 | 6397 |
| 60 | M | A | F | D | R | F | V | A | V | S | 8 | 6398 |
| 68 | V | S | N | P | L | R | Y | A | M | I | 8 | 6399 |
| 88 | V | A | S | V | I | R | G | L | L | M | 8 | 6400 |
| 103 | A | L | L | I | R | L | S | Y | C | H | 8 | 6401 |
| 118 | H | S | Y | C | Y | H | P | D | V | M | 8 | 6402 |
| 128 | K | L | S | C | T | D | T | R | I | N | 8 | 6403 |
| 141 | G | L | T | A | M | F | S | T | V | G | 8 | 6404 |
| 146 | F | S | T | V | G | V | D | L | L | L | 8 | 6405 |
| 159 | S | Y | V | L | I | I | R | T | V | L | 8 | 6406 |
| 205 | R | F | G | K | Q | A | P | A | Y | H | 8 | 6407 |
| 214 | V | H | T | M | I | A | N | T | Y | L | 8 | 6408 |
| 46 | I | K | F | F | T | V | M | E | S | S | 7 | 6409 |
| 52 | M | E | S | S | V | L | L | A | M | A | 7 | 6410 |
| 59 | A | M | A | F | D | R | F | V | A | V | 7 | 6411 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 64 | R | F | V | A | V | S | N | P | L | R | 7 | 6412 |
| 200 | L | S | I | V | H | R | F | G | K | Q | 7 | 6413 |
| 228 | L | M | N | P | V | I | Y | S | V | K | 7 | 6414 |
| 239 | K | Q | I | R | R | A | V | I | K | I | 7 | 6415 |
| 9 | S | A | T | D | L | G | L | S | I | S | 6 | 6416 |
| 26 | I | F | W | F | N | V | R | E | I | S | 6 | 6417 |
| 42 | H | M | F | F | I | K | F | F | T | V | 6 | 6418 |
| 62 | F | D | R | F | V | A | V | S | N | P | 6 | 6419 |
| 110 | Y | C | H | S | Q | V | L | H | H | S | 6 | 6420 |
| 121 | C | Y | H | P | D | V | M | K | L | S | 6 | 6421 |
| 123 | H | P | D | V | M | K | L | S | C | T | 6 | 6422 |
| 130 | S | C | T | D | T | R | I | N | S | A | 6 | 6423 |
| 134 | T | R | I | N | S | A | V | G | L | T | 6 | 6424 |
| 164 | I | R | T | V | L | S | V | A | S | P | 6 | 6425 |
| 179 | T | F | S | T | C | V | S | H | I | V | 6 | 6426 |
| 182 | T | C | V | S | H | I | V | A | F | A | 6 | 6427 |
| 207 | G | K | Q | A | P | A | Y | V | H | T | 6 | 6428 |
| 212 | A | Y | V | H | T | M | I | A | N | T | 6 | 6429 |
| 216 | T | M | I | A | N | T | Y | L | L | I | 6 | 6430 |
| 242 | R | R | A | V | I | K | I | L | H | S | 6 | 6431 |
| 1 | M | Y | Y | F | L | S | M | L | S | A | 5 | 6432 |
| 17 | I | S | T | L | V | T | M | L | S | I | 5 | 6433 |
| 38 | A | C | L | S | H | M | F | F | I | K | 5 | 6434 |
| 54 | S | S | V | L | L | A | M | A | F | D | 5 | 6435 |
| 66 | V | A | V | S | N | P | L | R | Y | A | 5 | 6436 |
| 84 | A | Q | I | G | V | A | S | V | I | R | 5 | 6437 |
| 102 | V | A | L | L | I | R | L | S | Y | C | 5 | 6438 |
| 109 | S | Y | C | H | S | Q | V | L | H | H | 5 | 6439 |
| 116 | L | H | H | S | Y | C | Y | H | P | D | 5 | 6440 |
| 140 | V | G | L | T | A | M | F | S | T | V | 5 | 6441 |
| 192 | I | Y | Y | T | P | L | I | S | L | S | 5 | 6442 |
| 193 | Y | Y | I | P | L | I | S | L | S | I | 5 | 6443 |
| 211 | P | A | Y | V | H | T | M | I | A | N | 5 | 6444 |
| 218 | I | A | N | T | Y | L | L | I | S | P | 5 | 6445 |
| 243 | R | A | V | I | K | I | L | H | S | K | 5 | 6446 |
| 24 | L | S | I | F | W | P | N | V | R | E | 4 | 6447 |
| 37 | N | A | C | L | S | H | M | F | F | I | 4 | 6448 |
| 70 | N | P | L | R | Y | A | M | I | L | T | 4 | 6449 |
| 72 | L | R | Y | A | M | I | L | T | D | S | 4 | 6450 |
| 81 | S | R | I | A | Q | I | G | V | A | S | 4 | 6451 |
| 100 | P | M | V | A | L | L | I | R | L | S | 4 | 6452 |
| 143 | T | A | M | F | S | T | V | G | V | D | 4 | 6453 |
| 158 | L | S | Y | V | L | I | I | R | T | V | 4 | 6454 |
| 226 | S | P | L | M | N | P | V | I | Y | S | 4 | 6455 |
| 230 | N | P | V | I | Y | S | V | K | T | K | 4 | 6456 |
| 32 | R | E | I | S | F | N | A | C | L | S | 3 | 6457 |
| 106 | I | R | L | S | Y | C | H | S | Q | V | 3 | 6458 |
| 122 | Y | H | P | D | V | M | K | L | S | C | 3 | 6459 |
| 138 | S | A | V | G | L | T | A | M | F | S | 3 | 6460 |
| 170 | V | A | S | P | E | E | R | K | E | T | 3 | 6461 |
| 229 | M | N | P | V | I | Y | S | V | K | T | 3 | 6462 |
| 8 | L | S | A | T | D | L | G | L | S | I | 2 | 6463 |
| 22 | T | M | L | S | I | F | W | F | N | V | 2 | 6464 |
| 73 | R | Y | A | M | I | L | T | D | S | R | 2 | 6465 |
| 74 | Y | A | M | I | L | T | D | S | R | I | 2 | 6466 |
| 75 | A | M | I | L | T | D | S | R | I | A | 2 | 6467 |
| 93 | R | G | L | L | M | L | T | P | M | V | 2 | 6468 |
| 119 | S | Y | C | Y | H | P | D | V | M | K | 2 | 6469 |
| 127 | M | K | L | S | C | T | D | T | R | I | 2 | 6470 |
| 172 | S | P | E | E | R | K | E | T | F | S | 2 | 6471 |
| 177 | K | E | T | F | S | T | C | V | S | H | 2 | 6472 |
| 190 | F | A | I | Y | Y | I | P | L | I | S | 2 | 6473 |
| 206 | F | G | K | Q | A | P | A | Y | V | H | 2 | 6474 |
| 209 | Q | A | P | A | Y | V | H | T | M | I | 2 | 6475 |
| 210 | A | P | A | Y | V | H | T | M | I | A | 2 | 6476 |
| 234 | Y | S | V | K | T | K | Q | I | R | R | 2 | 6477 |
| 236 | V | K | T | K | Q | I | R | R | A | V | 2 | 6478 |
| 13 | L | G | L | S | I | S | T | L | V | T | 1 | 6479 |
| 29 | F | N | V | R | E | I | S | F | N | A | 1 | 6480 |
| 79 | T | D | S | R | I | A | Q | I | G | V | 1 | 6481 |
| 83 | I | A | Q | I | G | V | A | S | V | I | 1 | 6482 |
| 108 | L | S | Y | C | H | S | Q | V | L | H | 1 | 6483 |
| 112 | H | S | Q | V | L | H | H | S | Y | C | 1 | 6484 |
| 117 | H | H | S | Y | C | Y | H | P | D | V | 1 | 6485 |
| 126 | V | M | K | L | S | C | T | D | T | R | 1 | 6486 |
| 129 | L | S | C | T | D | T | R | I | N | S | 1 | 6487 |
| 132 | T | D | T | R | I | N | S | A | V | G | 1 | 6488 |
| 168 | L | S | V | A | S | P | E | E | R | K | 1 | 6489 |
| 173 | P | E | E | R | K | E | T | F | S | T | 1 | 6490 |
| 198 | I | S | L | S | I | V | H | R | F | G | 1 | 6491 |
| 203 | V | H | R | F | G | K | Q | A | P | A | 1 | 6492 |
| 221 | T | Y | L | L | I | S | P | L | M | N | 1 | 6493 |
| 233 | I | Y | S | V | K | T | K | Q | I | R | 1 | 6494 |
| 238 | T | K | Q | I | R | R | A | V | I | K | 1 | 6495 |

HLA-A3 10-mers v.1: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 101 | M | V | A | L | L | I | R | L | S | Y | 24 | 6496 |
| 199 | S | L | S | I | V | H | R | F | G | K | 23 | 6497 |
| 213 | Y | V | H | T | M | I | A | N | T | Y | 23 | 6498 |
| 135 | R | I | N | S | A | V | G | L | T | A | 22 | 6499 |
| 55 | S | V | L | L | A | M | A | F | D | R | 21 | 6500 |
| 65 | F | V | A | V | S | N | P | L | R | Y | 21 | 6501 |
| 162 | L | I | I | R | T | V | L | S | V | A | 21 | 6502 |
| 196 | P | L | I | S | L | S | I | V | H | R | 21 | 6503 |
| 71 | P | L | R | Y | A | M | I | L | T | D | 20 | 6504 |
| 91 | V | I | R | G | L | L | M | L | T | P | 20 | 6505 |
| 103 | A | L | L | I | R | L | S | Y | C | H | 20 | 6506 |
| 228 | L | M | N | P | V | I | Y | S | V | K | 20 | 6507 |
| 14 | G | L | S | I | S | T | L | V | T | M | 19 | 6508 |
| 23 | M | L | S | I | F | W | F | N | V | R | 19 | 6509 |
| 77 | I | L | T | D | S | R | I | A | Q | I | 19 | 6510 |
| 97 | M | L | T | P | M | V | A | L | L | I | 19 | 6511 |
| 161 | V | L | I | I | R | T | V | L | S | V | 19 | 6512 |
| 244 | A | V | I | K | I | L | H | S | K | E | 19 | 6513 |
| 56 | V | L | L | A | M | A | F | D | R | F | 18 | 6514 |
| 82 | R | I | A | Q | I | G | V | A | S | V | 18 | 6515 |
| 90 | S | V | I | R | G | L | L | M | L | T | 18 | 6516 |
| 94 | G | L | L | M | L | T | P | M | V | A | 18 | 6517 |
| 107 | R | L | S | Y | C | H | S | Q | V | L | 18 | 6518 |
| 114 | Q | V | L | H | H | S | Y | C | Y | H | 18 | 6519 |
| 154 | L | L | I | L | L | S | Y | V | L | I | 18 | 6520 |
| 156 | I | L | S | Y | V | L | I | I | R | T | 18 | 6521 |
| 163 | I | I | R | T | V | L | S | V | A | S | 18 | 6522 |
| 238 | T | K | Q | I | R | R | A | V | I | K | 18 | 6523 |
| 33 | S | F | N | A | C | L | S | H | M | F | 17 | 6524 |
| 141 | G | L | T | A | M | F | S | T | V | G | 17 | 6525 |
| 153 | L | L | I | L | L | S | Y | V | L | I | 17 | 6526 |
| 160 | Y | V | L | I | I | R | T | V | L | S | 17 | 6527 |
| 191 | Y | Y | I | P | L | I | S | L | S | I | 17 | 6528 |
| 243 | R | A | V | I | K | I | L | H | S | K | 17 | 6529 |
| 67 | A | V | S | N | P | L | R | Y | A | M | 16 | 6530 |
| 84 | A | Q | I | G | V | A | S | V | I | R | 16 | 6531 |
| 95 | L | L | M | L | T | P | M | V | A | L | 16 | 6532 |
| 104 | L | L | I | R | L | S | Y | C | H | S | 16 | 6533 |
| 119 | S | Y | C | Y | H | P | D | V | M | K | 16 | 6534 |
| 139 | A | V | G | L | T | A | M | F | S | T | 16 | 6535 |
| 152 | D | L | L | I | L | L | S | Y | V | L | 16 | 6536 |
| 202 | I | V | H | R | F | C | K | Q | A | P | 16 | 6537 |
| 240 | Q | I | R | R | A | V | I | K | I | L | 16 | 6538 |
| 20 | L | V | T | M | L | S | I | F | W | F | 15 | 6539 |
| 30 | N | V | R | E | I | S | F | N | A | C | 15 | 6540 |
| 38 | A | C | L | S | H | M | F | F | I | K | 15 | 6541 |
| 61 | A | F | D | R | F | V | A | V | S | N | 15 | 6542 |
| 167 | V | L | S | V | A | S | P | E | E | R | 15 | 6543 |
| 201 | S | I | V | H | R | F | G | K | Q | A | 15 | 6544 |
| 224 | L | I | S | P | L | M | N | P | V | I | 15 | 6545 |
| 230 | N | P | V | I | Y | S | V | K | T | K | 15 | 6546 |
| 232 | V | I | Y | S | V | K | T | K | Q | I | 15 | 6547 |
| 4 | F | L | S | M | L | S | A | T | D | L | 14 | 6548 |
| 39 | C | L | S | H | M | F | F | I | K | F | 14 | 6549 |
| 50 | T | V | M | E | S | S | V | L | L | A | 14 | 6550 |
| 81 | S | R | I | A | Q | I | G | V | A | S | 14 | 6551 |
| 105 | L | I | R | L | S | Y | C | H | S | Q | 14 | 6552 |
| 150 | G | V | D | L | L | I | L | L | S | Y | 14 | 6553 |
| 151 | V | D | L | L | I | L | L | S | Y | V | 14 | 6554 |
| 155 | L | I | L | L | S | Y | V | L | I | I | 14 | 6555 |
| 183 | C | V | S | H | I | V | A | F | A | I | 14 | 6556 |
| 222 | Y | L | L | I | S | P | L | M | N | P | 14 | 6557 |
| 225 | I | S | P | L | M | N | P | V | I | Y | 14 | 6558 |

TABLE XIXB-continued part 1

| Pos1 | 2 | 3 | 4 | 5 | 6 | 7 | 8 | 9 | 0 | score | SEQ ID |
|---|---|---|---|---|---|---|---|---|---|---|---|
| 231P | V | I | Y | S | V | K | T | K | Q | 14 | 6559 |
| 7M | L | S | A | T | D | L | G | L | 5 | 13 | 6560 |
| 83I | A | Q | I | G | V | A | S | V | I | 13 | 6561 |
| 87G | V | A | S | V | I | R | G | L | L | 13 | 6562 |
| 128K | L | S | C | T | D | T | R | I | N | 13 | 6563 |
| 148T | V | G | V | D | L | L | L | I | L | 13 | 6564 |
| 177K | E | T | F | S | T | C | V | S | H | 13 | 6565 |
| 185S | H | I | V | A | F | A | I | Y | Y | 13 | 6566 |
| 187I | V | A | F | A | I | Y | Y | I | P | 13 | 6567 |
| 195I | P | L | I | S | L | S | I | V | H | 13 | 6568 |
| 197L | I | S | L | S | I | V | H | R | F | 13 | 6569 |
| 217M | I | A | N | T | Y | L | L | I | S | 13 | 6570 |
| 223L | L | I | S | P | L | M | N | P | V | 13 | 6571 |
| 227P | L | M | N | P | V | I | Y | S | V | 13 | 6572 |
| 12D | L | G | L | S | I | S | T | L | V | 12 | 6573 |
| 7M | I | L | T | D | S | R | I | A | Q | 12 | 6574 |
| 108L | S | Y | C | H | S | Q | V | L | L | 12 | 6575 |
| 166T | V | L | S | V | A | S | P | E | E | 12 | 6576 |
| 168L | S | V | A | S | P | E | E | R | K | 12 | 6577 |
| 169S | V | A | S | P | E | E | R | K | E | 12 | 6578 |
| 171A | S | P | E | E | R | K | E | T | F | 12 | 6579 |
| 194Y | I | P | L | I | S | L | S | I | V | 12 | 6580 |
| 204H | R | F | G | K | Q | A | P | A | Y | 12 | 6581 |
| 206F | G | K | Q | A | P | A | Y | V | H | 12 | 6582 |
| 235S | V | K | T | K | Q | I | R | R | A | 12 | 6583 |
| 237K | T | K | Q | I | R | R | A | V | I | 12 | 6584 |
| 11T | D | L | G | L | S | I | S | T | L | 11 | 6585 |
| 57L | L | A | M | A | F | D | R | F | V | 11 | 6586 |
| 73R | Y | A | M | I | L | T | D | S | R | 11 | 6587 |
| 125D | V | M | K | L | S | C | T | D | T | 11 | 6588 |
| 133D | T | R | I | N | S | A | V | G | L | 11 | 6589 |
| 165R | T | V | L | S | V | A | S | P | E | 11 | 6590 |
| 193Y | Y | I | P | L | I | S | L | S | I | 11 | 6591 |
| 208K | Q | A | P | A | Y | V | H | T | M | 11 | 6592 |
| 241I | R | R | A | V | I | K | I | L | H | 11 | 6593 |
| 16S | I | S | T | L | V | T | M | L | S | 10 | 6594 |
| 18S | T | L | V | T | M | L | S | I | F | 10 | 6595 |
| 19T | L | V | T | M | L | S | I | F | W | 10 | 6596 |
| 32R | E | I | S | F | N | A | C | L | S | 10 | 6597 |
| 45F | I | K | F | F | T | V | M | E | S | 10 | 6598 |
| 64R | F | V | A | V | S | N | P | L | R | 10 | 6599 |
| 85Q | I | G | V | A | S | V | I | R | G | 10 | 6600 |
| 106I | R | L | S | Y | C | H | S | Q | V | 10 | 6601 |
| 115V | L | H | H | S | Y | C | Y | H | P | 10 | 6602 |
| 126V | M | K | L | S | C | T | D | T | R | 10 | 6603 |
| 132T | D | T | R | I | N | S | A | V | G | 10 | 6604 |
| 144A | M | F | S | T | V | G | V | D | L | 10 | 6605 |
| 157L | L | S | Y | V | L | I | I | R | T | 10 | 6606 |
| 174E | E | R | K | E | T | F | S | T | C | 10 | 6607 |
| 181S | T | C | V | S | H | I | V | A | F | 10 | 6608 |
| 184V | S | H | I | V | A | F | A | I | Y | 10 | 6609 |
| 186H | I | V | A | F | A | I | Y | Y | I | 10 | 6610 |
| 192I | Y | Y | I | P | L | I | S | L | S | 10 | 6611 |
| 245V | I | K | I | L | H | S | K | E | T | 10 | 6612 |
| 1M | Y | Y | F | L | S | M | L | S | A | 9 | 6613 |
| 3Y | F | L | S | M | L | S | A | T | D | 9 | 6614 |
| 8L | S | A | T | D | L | G | L | S | I | 9 | 6615 |
| 13L | G | L | S | I | S | T | L | V | T | 9 | 6616 |
| 25S | I | F | W | F | N | V | R | E | I | 9 | 6617 |
| 53E | S | S | V | L | L | A | M | A | F | 9 | 6618 |
| 59A | M | A | F | D | R | F | V | A | V | 9 | 6619 |
| 80S | R | I | A | Q | I | G | V | A | S | 9 | 6620 |
| 118H | S | Y | C | Y | H | P | D | V | M | 9 | 6621 |
| 137N | S | A | V | G | L | T | A | M | F | 9 | 6622 |
| 140V | G | L | T | A | M | F | S | T | V | 9 | 6623 |
| 239K | Q | I | R | R | A | V | I | K | I | 9 | 6624 |
| 17I | S | T | L | V | T | M | L | S | I | 9 | 6625 |
| 35S | F | N | A | C | L | S | H | M | F | 8 | 6626 |
| 44F | F | I | K | F | F | T | V | M | E | 8 | 6627 |
| 47K | F | F | T | V | M | E | S | S | V | 8 | 6628 |
| 60M | A | F | D | R | F | V | A | V | S | 8 | 6629 |
| 89A | S | V | I | R | G | L | L | M | S | 8 | 6630 |
| 93R | G | L | L | M | S | L | T | P | M | 8 | 6631 |
| 109S | Y | C | H | S | Q | V | L | H | H | 8 | 6632 |
| 111C | H | S | Q | V | L | H | H | S | Y | 8 | 6633 |
| 113S | Q | V | L | H | S | Y | C | Y | 8 | 6634 |
| 158L | S | Y | V | L | I | I | R | T | V | 8 | 6635 |
| 159S | Y | V | L | I | I | R | T | V | L | 8 | 6636 |
| 176R | K | E | T | F | S | T | C | V | S | 8 | 6637 |
| 205R | F | G | K | Q | A | P | A | Y | V | 8 | 6638 |
| 216T | M | I | A | N | T | Y | L | L | I | 8 | 6639 |
| 221T | Y | L | L | I | S | P | L | M | N | 8 | 6640 |
| 242R | R | A | V | I | K | I | L | H | S | 8 | 6641 |
| 24L | S | I | F | W | F | N | V | R | E | 7 | 6642 |
| 27F | W | F | N | V | R | E | I | S | F | 7 | 6643 |
| 48F | F | T | V | M | E | S | S | V | L | 7 | 6644 |
| 58L | A | M | A | F | D | R | F | V | A | 7 | 6645 |
| 68V | S | N | P | L | R | Y | A | M | I | 7 | 6646 |
| 72L | R | Y | A | M | I | L | T | D | S | 7 | 6647 |
| 75A | M | I | L | T | D | S | R | I | A | 7 | 6648 |
| 98L | T | P | M | V | A | L | L | I | R | 7 | 6649 |
| 138S | A | V | G | L | T | A | M | F | S | 7 | 6650 |
| 164I | R | T | V | L | S | V | A | S | P | 7 | 6651 |
| 190F | A | I | Y | Y | I | P | L | I | S | 7 | 6652 |
| 6S | M | L | S | A | T | D | L | G | L | 6 | 6653 |
| 10A | T | D | L | G | L | S | I | S | T | 6 | 6654 |
| 34I | S | F | N | A | C | L | S | H | M | 6 | 6655 |
| 36F | N | A | C | L | S | H | M | F | F | 6 | 6656 |
| 43M | F | F | I | K | F | F | T | V | M | 6 | 6657 |
| 62F | D | R | F | V | A | V | S | N | P | 6 | 6658 |
| 69S | N | P | L | R | Y | A | M | I | L | 6 | 6659 |
| 88V | A | S | V | I | R | G | L | L | M | 6 | 6660 |
| 102V | A | L | L | I | R | L | S | Y | C | 6 | 6661 |
| 122Y | H | P | D | V | M | K | L | S | C | 6 | 6662 |
| 136I | N | S | A | V | G | L | T | A | M | 6 | 6663 |
| 147S | T | V | G | V | D | L | L | L | I | 6 | 6664 |
| 203V | H | R | F | G | K | Q | A | P | A | 6 | 6665 |
| 207G | K | Q | A | P | A | Y | V | H | T | 6 | 6666 |
| 209Q | A | P | A | Y | V | H | T | M | I | 6 | 6667 |
| 212A | Y | V | H | T | M | I | A | N | T | 6 | 6668 |
| 219A | N | T | Y | L | L | I | S | P | L | 6 | 6669 |
| 233I | Y | S | V | K | T | K | Q | I | R | 6 | 6670 |
| 2Y | Y | F | L | S | M | L | S | A | T | 5 | 6671 |
| 9S | A | T | D | L | G | L | S | I | S | 5 | 6672 |
| 15L | S | I | S | T | L | V | T | M | L | 5 | 6673 |
| 54S | V | L | L | A | M | A | F | D | R | 5 | 6674 |
| 70N | P | L | R | Y | A | M | I | L | T | 5 | 6675 |
| 96L | M | L | T | P | M | V | A | L | L | 5 | 6676 |
| 120Y | C | Y | H | P | D | V | M | K | L | 5 | 6677 |
| 134T | R | I | N | S | A | V | G | L | T | 5 | 6678 |
| 142L | T | A | M | F | S | T | V | G | V | 5 | 6679 |
| 143T | A | M | F | S | T | V | G | V | D | 5 | 6680 |
| 173P | E | E | R | K | E | T | F | S | T | 5 | 6681 |
| 189A | F | A | I | Y | Y | I | P | L | I | 5 | 6682 |
| 210A | P | A | Y | V | H | T | M | I | A | 5 | 6683 |
| 211P | A | Y | V | H | T | M | I | A | N | 5 | 6684 |
| 220N | T | Y | L | L | I | S | P | L | M | 5 | 6685 |
| 31V | R | E | I | S | F | N | A | C | L | 4 | 6686 |
| 40L | S | H | M | F | F | I | K | F | F | 4 | 6687 |
| 42H | M | F | F | I | K | F | F | T | V | 4 | 6688 |
| 46I | K | F | F | T | V | M | E | S | S | 4 | 6689 |
| 49F | T | V | M | E | S | S | V | L | L | 4 | 6690 |
| 51V | M | E | S | S | V | L | L | A | M | 4 | 6691 |
| 52M | E | S | S | V | L | L | A | M | A | 4 | 6692 |
| 74Y | A | M | I | L | T | D | S | R | I | 4 | 6693 |
| 86I | G | V | A | S | V | I | R | G | L | 4 | 6694 |
| 92I | R | G | L | L | M | S | L | T | P | 4 | 6695 |
| 124P | D | V | M | K | L | S | C | T | D | 4 | 6696 |
| 130S | C | T | D | T | R | I | N | S | A | 4 | 6697 |
| 131C | T | D | T | R | I | N | S | A | V | 4 | 6698 |
| 170A | S | P | E | E | R | K | E | T | F | 4 | 6699 |
| 180F | S | T | C | V | S | H | I | V | A | 4 | 6700 |
| 198I | S | L | S | I | V | H | R | F | G | 4 | 6701 |
| 200L | S | I | V | H | R | F | G | K | Q | 4 | 6702 |
| 218I | A | N | T | Y | L | L | I | S | P | 4 | 6703 |
| 229M | N | P | V | I | Y | S | V | K | T | 4 | 6704 |
| 234Y | S | V | K | T | K | Q | I | R | R | 4 | 6705 |
| 26I | F | W | F | N | V | R | E | I | S | 3 | 6706 |
| 28W | F | N | V | R | E | I | S | F | N | 3 | 6707 |
| 29F | N | V | R | E | I | S | F | N | A | 3 | 6708 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 78 | L | T | D | S | R | I | A | Q | I | G | 3 | 6709 |
| 79 | T | D | S | R | I | A | Q | I | G | V | 3 | 6710 |
| 112 | H | S | Q | V | L | H | H | S | Y | C | 3 | 6711 |
| 121 | C | Y | H | P | D | V | M | K | L | S | 3 | 6712 |
| 123 | H | P | D | V | M | K | L | S | C | T | 3 | 6713 |
| 127 | M | K | L | S | C | T | D | T | R | I | 3 | 6714 |
| 146 | F | S | T | V | G | V | D | L | L | L | 3 | 6715 |
| 172 | S | P | E | E | R | K | E | T | F | S | 3 | 6716 |
| 175 | E | R | K | E | T | F | S | T | C | V | 3 | 6717 |
| 178 | E | T | F | S | T | C | V | S | H | I | 3 | 6718 |
| 182 | T | C | V | S | H | I | V | A | F | A | 3 | 6719 |
| 226 | S | P | L | M | N | P | V | I | Y | S | 3 | 6720 |
| 22 | T | M | L | S | I | F | W | F | N | V | 2 | 6721 |
| 100 | P | M | V | A | L | L | I | R | L | S | 2 | 6722 |
| 188 | V | A | F | A | I | Y | Y | I | P | L | 2 | 6723 |
| 236 | V | K | T | K | Q | I | R | R | A | V | 2 | 6724 |
| 5 | L | S | M | L | S | A | T | D | L | G | 1 | 6725 |
| 21 | V | T | M | L | S | I | F | W | F | N | 1 | 6726 |
| 37 | N | A | C | L | S | H | M | F | F | I | 1 | 6727 |
| 41 | S | H | M | F | F | I | K | F | F | T | 1 | 6728 |
| 129 | L | S | C | T | D | T | R | I | N | S | 1 | 6729 |
| 149 | V | G | V | D | L | L | L | I | L | L | 1 | 6730 |
| 214 | V | H | T | M | I | A | N | T | Y | L | 1 | 6731 |
| 215 | H | T | M | I | A | N | T | Y | L | L | 1 | 6732 |

HLA-B*0702 10-mers v.1: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 99 | T | P | M | V | A | L | L | I | R | L | 21 | 6733 |
| 210 | A | P | A | Y | V | H | T | M | I | A | 20 | 6734 |
| 123 | H | P | D | V | M | K | L | S | C | T | 17 | 6735 |
| 70 | N | P | L | R | Y | A | M | I | L | T | 16 | 6736 |
| 89 | A | S | V | I | R | G | L | L | M | L | 14 | 6737 |
| 95 | L | L | M | L | T | P | M | V | A | L | 14 | 6738 |
| 107 | R | L | S | Y | C | H | S | Q | V | L | 14 | 6739 |
| 133 | D | T | R | I | N | S | A | V | G | L | 14 | 6740 |
| 144 | A | M | F | S | T | V | G | V | D | L | 14 | 6741 |
| 4 | F | L | S | M | L | S | A | T | D | L | 13 | 6742 |
| 59 | A | M | A | F | D | R | F | V | A | V | 13 | 6743 |
| 145 | M | F | S | T | V | G | V | D | L | L | 13 | 6744 |
| 148 | T | V | G | V | D | L | L | L | I | L | 13 | 6745 |
| 159 | S | Y | V | L | I | I | R | T | V | L | 13 | 6746 |
| 219 | A | N | T | Y | L | L | I | S | P | L | 13 | 6747 |
| 6 | S | M | L | S | A | T | D | L | G | L | 12 | 6748 |
| 11 | T | D | L | G | L | S | I | S | T | L | 12 | 6749 |
| 15 | L | S | I | S | T | L | V | T | M | L | 12 | 6750 |
| 49 | F | T | V | M | E | S | S | V | L | L | 12 | 6751 |
| 67 | A | V | S | N | P | L | R | Y | A | M | 12 | 6752 |
| 86 | I | G | V | A | S | V | I | R | G | L | 12 | 6753 |
| 87 | G | V | A | S | V | I | R | G | L | L | 12 | 6754 |
| 96 | L | M | L | T | P | M | V | A | L | L | 12 | 6755 |
| 136 | I | N | S | A | V | G | L | T | A | M | 12 | 6756 |
| 146 | F | S | T | V | G | V | D | L | L | L | 12 | 6757 |
| 172 | S | P | E | E | R | K | E | T | F | S | 12 | 6758 |
| 188 | V | A | F | A | I | Y | Y | I | P | L | 12 | 6759 |
| 191 | A | I | Y | Y | I | P | L | I | S | L | 12 | 6760 |
| 195 | I | P | L | I | S | L | S | I | V | H | 12 | 6761 |
| 215 | H | T | M | I | A | N | T | Y | L | L | 12 | 6762 |
| 240 | Q | I | R | R | A | V | I | K | I | L | 12 | 6763 |
| 31 | V | R | E | I | S | F | N | A | C | L | 11 | 6764 |
| 48 | F | F | T | V | M | E | S | S | V | L | 11 | 6765 |
| 63 | D | R | F | V | A | V | S | N | P | L | 11 | 6766 |
| 120 | Y | C | Y | H | P | D | V | M | K | L | 11 | 6767 |
| 153 | L | L | L | I | L | L | S | Y | V | L | 11 | 6768 |
| 214 | V | H | T | M | I | A | N | T | Y | L | 11 | 6769 |
| 224 | L | I | S | P | L | M | N | P | V | I | 11 | 6770 |
| 226 | S | P | L | M | N | P | V | I | Y | S | 11 | 6771 |
| 230 | N | P | V | I | Y | S | V | K | T | K | 11 | 6772 |
| 13 | L | G | L | S | I | S | T | L | V | T | 10 | 6773 |
| 14 | G | L | S | I | S | T | L | V | T | M | 10 | 6774 |
| 50 | T | V | M | E | S | S | V | L | L | A | 10 | 6775 |
| 53 | E | S | S | V | L | L | A | M | A | F | 10 | 6776 |
| 58 | L | A | M | A | F | D | R | F | V | A | 10 | 6777 |
| 69 | S | N | P | L | R | Y | A | M | I | L | 10 | 6778 |
| 82 | R | I | A | Q | I | G | V | A | S | V | 10 | 6779 |
| 88 | V | A | S | V | I | R | G | L | L | M | 10 | 6780 |
| 92 | I | R | G | L | L | M | L | T | P | M | 10 | 6781 |
| 142 | L | T | A | M | F | S | T | V | G | V | 10 | 6782 |
| 147 | S | T | V | G | V | D | L | L | L | I | 10 | 6783 |
| 149 | V | G | V | D | L | L | L | I | L | L | 10 | 6784 |
| 170 | V | A | S | P | E | E | R | K | E | T | 10 | 6785 |
| 189 | A | F | A | I | Y | Y | I | P | L | I | 10 | 6786 |
| 203 | V | H | R | F | G | K | Q | A | P | A | 10 | 6787 |
| 205 | R | F | G | K | Q | A | P | A | Y | V | 10 | 6788 |
| 208 | K | Q | A | P | A | Y | V | H | T | M | 10 | 6789 |
| 237 | K | T | K | Q | I | R | R | A | V | I | 10 | 6790 |
| 8 | L | S | A | T | D | L | G | L | S | I | 9 | 6791 |
| 10 | A | T | D | L | G | L | S | I | S | T | 9 | 6792 |
| 17 | I | S | T | L | V | T | M | L | S | I | 9 | 6793 |
| 39 | C | L | S | H | M | F | F | I | K | F | 9 | 6794 |
| 43 | M | F | F | I | K | F | F | T | V | M | 9 | 6795 |
| 51 | V | M | E | S | S | V | L | L | A | M | 9 | 6796 |
| 52 | M | E | S | S | V | L | L | A | M | A | 9 | 6797 |
| 80 | D | S | R | I | A | Q | I | G | V | A | 9 | 6798 |
| 93 | R | G | L | L | M | L | T | P | M | V | 9 | 6799 |
| 97 | M | L | T | P | M | V | A | L | L | I | 9 | 6800 |
| 117 | H | H | S | Y | C | Y | H | P | D | V | 9 | 6801 |
| 125 | D | V | M | K | L | S | C | T | D | T | 9 | 6802 |
| 135 | R | I | N | S | A | V | G | L | T | A | 9 | 6803 |
| 137 | N | S | A | V | G | L | T | A | M | F | 9 | 6804 |
| 139 | A | V | G | L | T | A | M | F | S | T | 9 | 6805 |
| 155 | L | I | L | L | S | Y | V | L | I | I | 9 | 6806 |
| 161 | V | L | I | I | R | T | V | L | S | V | 9 | 6807 |
| 181 | S | T | C | V | S | H | I | V | A | F | 9 | 6808 |
| 182 | T | C | V | S | H | I | V | A | F | A | 9 | 6809 |
| 183 | C | V | S | H | I | V | A | F | A | F | 9 | 6810 |
| 193 | Y | Y | I | P | L | I | S | L | S | I | 9 | 6811 |
| 197 | L | I | S | L | S | I | V | H | R | F | 9 | 6812 |
| 207 | G | K | Q | A | P | A | Y | V | H | T | 9 | 6813 |
| 212 | A | Y | V | H | T | M | I | A | N | T | 9 | 6814 |
| 216 | T | M | I | A | N | T | Y | L | L | I | 9 | 6815 |
| 236 | V | K | T | K | Q | I | R | R | A | V | 9 | 6816 |
| 1 | M | Y | Y | F | L | S | M | L | S | A | 8 | 6817 |
| 12 | D | L | G | L | S | I | S | T | L | V | 8 | 6818 |
| 36 | F | N | A | C | L | S | H | M | F | F | 8 | 6819 |
| 41 | S | H | M | F | F | I | K | F | F | T | 8 | 6820 |
| 56 | V | L | L | A | M | A | F | D | R | F | 8 | 6821 |
| 57 | L | L | A | M | A | F | D | R | F | V | 8 | 6822 |
| 68 | V | S | N | P | L | R | Y | A | M | I | 8 | 6823 |
| 75 | A | M | I | L | T | D | S | R | I | A | 8 | 6824 |
| 77 | I | L | T | D | S | R | I | A | Q | I | 8 | 6825 |
| 79 | T | D | S | R | I | A | Q | I | G | V | 8 | 6826 |
| 83 | I | A | Q | I | G | V | A | S | V | I | 8 | 6827 |
| 131 | C | T | D | T | R | I | N | S | A | V | 8 | 6828 |
| 154 | L | L | I | L | L | S | Y | V | L | I | 8 | 6829 |
| 157 | L | L | S | Y | V | L | I | I | R | T | 8 | 6830 |
| 171 | A | S | P | E | E | R | K | E | T | F | 8 | 6831 |
| 175 | E | R | K | E | T | F | S | T | C | V | 8 | 6832 |
| 178 | E | T | F | S | T | C | V | S | H | I | 8 | 6833 |
| 179 | T | F | S | T | C | V | S | H | I | V | 8 | 6834 |
| 209 | Q | A | P | A | Y | V | H | T | M | I | 8 | 6835 |
| 229 | M | N | P | V | I | Y | S | V | K | T | 8 | 6836 |
| 239 | K | Q | I | R | R | A | V | I | K | I | 8 | 6837 |
| 2 | Y | Y | F | L | S | M | L | S | A | T | 7 | 6838 |
| 25 | S | I | F | W | F | N | V | R | E | I | 7 | 6839 |
| 34 | I | S | F | N | A | C | L | S | H | M | 7 | 6840 |
| 35 | S | F | N | A | C | L | S | H | M | F | 7 | 6841 |
| 37 | N | A | C | L | S | H | M | F | F | I | 7 | 6842 |
| 40 | L | S | H | M | F | F | I | K | F | F | 7 | 6843 |
| 42 | H | M | F | F | I | K | F | F | T | V | 7 | 6844 |
| 47 | K | F | F | T | V | M | E | S | S | V | 7 | 6845 |
| 74 | Y | A | M | I | L | T | D | S | R | I | 7 | 6846 |
| 94 | G | L | L | M | L | T | P | M | V | A | 7 | 6847 |
| 106 | I | R | L | S | Y | C | H | S | Q | V | 7 | 6848 |
| 118 | H | S | Y | C | Y | H | P | D | V | M | 7 | 6849 |
| 127 | M | K | L | S | C | T | D | T | R | I | 7 | 6850 |
| 134 | T | R | I | N | S | A | V | G | L | T | 7 | 6851 |
| 140 | V | G | L | T | A | M | F | S | T | V | 7 | 6852 |
| 162 | L | I | R | T | V | L | S | V | A | 7 | 6853 |
| 173 | P | E | E | R | K | E | T | F | S | T | 7 | 6854 |
| 180 | F | S | T | C | V | S | H | I | V | A | 7 | 6855 |

TABLE XIXB-continued part 1

| Pos1 | 2 | 3 | 4 | 5 | 6 | 7 | 8 | 9 | 0 | score | SEQ ID |
|---|---|---|---|---|---|---|---|---|---|---|---|
| 186H | I | V | A | F | A | I | Y | Y | I | 7 | 6856 |
| 220N | T | Y | L | L | I | S | P | L | M | 7 | 6857 |
| 223L | L | I | S | P | L | M | N | P | V | 7 | 6858 |
| 227P | L | M | N | P | V | I | Y | S | V | 7 | 6859 |
| 232V | I | Y | S | V | K | T | K | Q | I | 7 | 6860 |
| 18S | T | L | V | T | M | L | S | I | F | 6 | 6861 |
| 20L | V | T | M | L | S | I | F | W | F | 6 | 6862 |
| 22T | M | L | S | I | F | W | F | N | V | 6 | 6863 |
| 27F | W | F | N | V | R | E | I | S | F | 6 | 6864 |
| 29F | N | V | R | E | I | S | F | N | A | 6 | 6865 |
| 66V | A | V | S | N | P | L | R | Y | A | 6 | 6866 |
| 84A | Q | I | G | V | A | S | V | I | R | 6 | 6867 |
| 90S | V | I | R | G | L | L | M | L | T | 6 | 6868 |
| 91V | I | R | G | L | L | M | L | T | P | 6 | 6869 |
| 130S | C | T | D | T | R | I | N | S | A | 6 | 6870 |
| 152D | L | L | L | I | L | L | S | Y | V | 6 | 6871 |
| 158L | S | Y | V | L | I | I | R | T | V | 6 | 6872 |
| 163I | I | R | T | V | L | S | V | A | S | 6 | 6873 |
| 194Y | I | P | L | I | S | L | S | I | V | 6 | 6874 |
| 201S | I | V | H | R | F | G | K | Q | A | 6 | 6875 |
| 235S | V | K | T | K | Q | I | R | R | A | 6 | 6876 |
| 245V | I | K | I | L | H | S | K | E | T | 6 | 6877 |
| 33E | I | S | F | N | A | C | L | S | H | 5 | 6878 |
| 61A | F | D | R | F | V | A | V | S | N | 5 | 6879 |
| 174E | E | R | K | E | T | F | S | T | C | 5 | 6880 |
| 23M | L | S | I | F | W | F | N | V | R | 4 | 6881 |
| 30N | V | R | E | I | S | F | N | A | C | 4 | 6882 |
| 44F | F | I | K | F | F | T | V | M | E | 4 | 6883 |
| 71P | L | R | Y | A | M | I | L | T | D | 4 | 6884 |
| 81S | R | I | A | Q | I | G | V | A | S | 4 | 6885 |
| 101M | V | A | L | L | I | R | L | S | Y | 4 | 6886 |
| 128K | L | S | C | T | D | T | R | I | N | 4 | 6887 |
| 204H | R | F | G | K | Q | A | P | A | Y | 4 | 6888 |
| 241I | R | R | A | V | I | K | I | L | H | 4 | 6889 |
| 242R | R | A | V | I | K | I | L | H | S | 4 | 6890 |
| 7M | L | S | A | T | D | L | G | L | S | 3 | 6891 |
| 16S | I | S | T | L | V | T | M | L | S | 3 | 6892 |
| 21V | T | M | L | S | I | F | W | F | N | 3 | 6893 |
| 38A | C | L | S | H | M | F | F | I | K | 3 | 6894 |
| 60M | A | F | D | R | F | V | A | V | S | 3 | 6895 |
| 62F | D | R | F | V | A | V | S | N | P | 3 | 6896 |
| 64R | F | V | A | V | S | N | P | L | R | 3 | 6897 |
| 65F | V | A | V | S | N | P | L | R | Y | 3 | 6898 |
| 73R | Y | A | M | I | L | T | D | S | R | 3 | 6899 |
| 109S | Y | C | H | S | Q | V | L | H | H | 3 | 6900 |
| 138S | A | V | G | L | T | A | M | F | S | 3 | 6901 |
| 141G | L | T | A | M | F | S | T | V | G | 3 | 6902 |
| 143T | A | M | F | S | T | V | G | V | D | 3 | 6903 |
| 150G | V | D | L | L | L | I | L | L | S | 3 | 6904 |
| 160Y | V | L | I | I | R | T | V | L | S | 3 | 6905 |
| 164I | R | T | V | L | S | V | A | S | P | 3 | 6906 |
| 176R | K | E | T | F | S | T | C | V | S | 3 | 6907 |
| 177K | E | T | F | S | T | C | V | S | H | 3 | 6908 |
| 199S | L | S | I | V | H | R | F | G | K | 3 | 6909 |
| 217M | I | A | N | T | Y | L | L | I | S | 3 | 6910 |
| 225I | S | P | L | M | N | P | V | I | Y | 3 | 6911 |
| 233I | Y | S | V | K | T | K | Q | I | R | 3 | 6912 |
| 244A | V | I | K | I | L | H | S | K | E | 3 | 6913 |
| 5L | S | M | L | S | A | T | D | L | G | 2 | 6914 |
| 24L | S | I | F | W | F | N | V | R | E | 2 | 6915 |
| 26I | F | W | F | N | V | R | E | I | S | 2 | 6916 |
| 54S | S | V | L | L | A | M | A | F | D | 2 | 6917 |
| 72L | R | Y | A | M | I | L | T | D | S | 2 | 6918 |
| 76M | I | L | T | D | S | R | I | A | Q | 2 | 6919 |
| 85Q | I | G | V | A | S | V | I | R | G | 2 | 6920 |
| 98L | T | P | M | V | A | L | L | I | R | 2 | 6921 |
| 103A | L | L | I | R | L | S | Y | C | H | 2 | 6922 |
| 105L | I | R | L | S | Y | C | H | S | Q | 2 | 6923 |
| 108L | S | Y | C | H | S | Q | V | L | H | 2 | 6924 |
| 111C | H | S | Q | V | L | H | H | S | Y | 2 | 6925 |
| 119S | Y | C | H | P | D | V | M | K | L | 2 | 6926 |
| 122Y | H | P | D | V | M | K | L | S | C | 2 | 6927 |
| 132T | D | T | R | I | N | S | A | V | G | 2 | 6928 |
| 151V | D | L | L | L | I | L | L | S | Y | 2 | 6929 |
| 165R | T | V | L | S | V | A | S | P | E | 2 | 6930 |
| 167V | L | S | V | A | S | P | E | E | R | 2 | 6931 |
| 184V | S | H | I | V | A | F | A | I | Y | 2 | 6932 |
| 187I | V | A | F | A | I | Y | Y | I | P | 2 | 6933 |
| 190F | A | I | Y | Y | I | P | L | I | S | 2 | 6934 |
| 196P | L | I | S | L | S | I | V | H | R | 2 | 6935 |
| 198I | S | L | S | I | V | H | R | F | G | 2 | 6936 |
| 202I | V | H | R | F | G | K | Q | A | P | 2 | 6937 |
| 221T | Y | L | L | I | S | P | L | M | N | 2 | 6938 |
| 228L | M | N | P | V | I | Y | S | V | K | 2 | 6939 |
| 238T | K | Q | I | R | R | A | V | I | K | 2 | 6940 |
| 3Y | F | L | S | M | L | S | A | T | D | 1 | 6941 |
| 19T | L | V | T | M | L | S | I | F | W | 1 | 6942 |
| 28W | F | N | V | R | E | I | S | F | N | 1 | 6943 |
| 32R | E | I | S | F | N | A | C | L | S | 1 | 6944 |
| 45F | I | K | F | F | T | V | M | E | S | 1 | 6945 |
| 46I | K | F | F | T | V | M | E | S | S | 1 | 6946 |
| 78L | T | D | S | R | I | A | Q | I | G | 1 | 6947 |
| 100P | M | V | A | L | L | I | R | L | S | 1 | 6948 |
| 116L | H | H | S | Y | C | Y | H | P | D | 1 | 6949 |
| 121C | Y | H | P | D | V | M | K | L | S | 1 | 6950 |
| 126V | M | K | L | S | C | T | D | T | R | 1 | 6951 |
| 129L | S | C | T | D | T | R | I | N | S | 1 | 6952 |
| 156I | L | S | Y | V | L | I | I | R | 1 | 6953 |
| 166T | V | L | S | V | A | S | P | E | E | 1 | 6954 |
| 168S | V | A | S | P | E | E | R | K | E | 1 | 6955 |
| 169S | V | A | S | P | E | E | R | K | E | 1 | 6956 |
| 192I | Y | Y | I | P | L | I | S | L | S | 1 | 6957 |
| 200L | S | I | V | H | R | F | G | K | Q | 1 | 6958 |
| 206F | G | K | Q | A | P | A | Y | V | H | 1 | 6959 |
| 211P | A | Y | V | H | T | M | I | A | N | 1 | 6960 |
| 218I | A | N | T | Y | L | L | I | S | P | 1 | 6961 |
| 231P | V | I | Y | S | V | K | T | K | Q | 1 | 6962 |
| 234Y | S | V | K | T | K | Q | I | R | R | 1 | 6963 |
| 243R | A | V | I | K | I | L | H | S | K | 1 | 6964 |

HLA-B*4402 10-mers v.1: 238P1B2

| Pos1 | 2 | 3 | 4 | 5 | 6 | 7 | 8 | 9 | 0 | score | SEQ ID |
|---|---|---|---|---|---|---|---|---|---|---|---|
| 181S | T | C | V | S | H | I | V | A | F | 17 | 6965 |
| 11T | D | L | G | L | S | I | S | T | L | 16 | 6966 |
| 53E | S | S | V | L | L | A | M | A | F | 16 | 6967 |
| 144M | F | S | T | V | G | V | D | L | L | 16 | 6968 |
| 185S | H | I | V | A | F | A | I | Y | Y | 16 | 6969 |
| 204H | R | F | G | K | Q | A | P | A | Y | 16 | 6970 |
| 219A | N | T | Y | L | L | I | S | P | L | 16 | 6971 |
| 239K | Q | I | R | R | A | V | I | K | I | 16 | 6972 |
| 240I | R | R | A | V | I | K | I | L | 16 | 6973 |
| 32R | E | I | S | F | N | A | C | L | S | 15 | 6974 |
| 40L | S | H | M | F | F | I | K | F | F | 15 | 6975 |
| 89A | S | V | I | R | G | L | L | M | L | 15 | 6976 |
| 95L | L | M | L | T | P | M | V | A | L | 15 | 6977 |
| 171A | S | P | E | E | R | K | E | T | F | 15 | 6978 |
| 189A | F | A | I | Y | Y | I | P | L | I | 15 | 6979 |
| 191A | I | Y | Y | I | P | L | I | S | L | 15 | 6980 |
| 193Y | Y | I | P | L | I | S | L | S | I | 15 | 6981 |
| 15L | S | I | S | T | L | V | T | M | L | 14 | 6982 |
| 27F | W | F | N | V | R | E | I | S | F | 14 | 6983 |
| 39C | L | S | H | M | F | F | I | K | F | 14 | 6984 |
| 69S | N | P | L | R | Y | A | M | I | L | 14 | 6985 |
| 86I | G | V | A | S | V | I | R | G | 14 | 6986 |
| 96L | M | L | T | P | M | V | A | L | L | 14 | 6987 |
| 97M | L | T | P | M | V | A | L | L | I | 14 | 6988 |
| 145M | F | S | T | V | G | V | D | L | L | 14 | 6989 |
| 149V | G | V | D | L | L | L | I | L | L | 14 | 6990 |
| 151V | D | L | L | L | I | L | L | S | Y | 14 | 6991 |
| 154L | L | I | L | L | S | Y | V | L | I | 14 | 6992 |
| 159S | Y | V | L | I | I | R | T | V | L | 14 | 6993 |
| 174E | E | R | K | E | T | F | S | T | C | 14 | 6994 |
| 197L | I | S | L | S | I | V | H | R | F | 14 | 6995 |
| 213Y | V | H | T | M | I | A | N | T | Y | 14 | 6996 |
| 225I | S | P | L | M | N | P | V | I | Y | 14 | 6997 |
| 6M | L | S | A | T | D | L | C | L | 13 | 6998 |
| 18S | T | L | V | T | M | L | S | I | F | 13 | 6999 |
| 20L | V | T | M | L | S | I | F | W | F | 13 | 7000 |
| 25S | I | F | W | F | N | V | R | E | I | 13 | 7001 |
| 63D | R | F | V | A | V | S | N | P | L | 13 | 7002 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 77 | I | L | T | D | S | R | I | A | Q | I | 13 | 7003 |
| 99 | T | P | M | V | A | L | L | I | R | L | 13 | 7004 |
| 101 | M | V | A | L | L | I | R | L | S | Y | 13 | 7005 |
| 147 | S | T | V | G | V | D | L | L | L | I | 13 | 7006 |
| 178 | E | T | F | S | T | C | V | S | H | I | 13 | 7007 |
| 188 | V | A | F | A | I | Y | Y | I | P | L | 13 | 7008 |
| 215 | H | T | M | I | A | N | T | Y | L | L | 13 | 7009 |
| 216 | T | M | I | A | N | T | Y | L | L | I | 13 | 7010 |
| 224 | L | I | S | P | L | M | N | P | V | I | 13 | 7011 |
| 4 | F | L | S | M | L | S | A | T | D | L | 12 | 7012 |
| 19 | T | L | V | T | M | L | S | I | F | W | 12 | 7013 |
| 35 | S | F | N | A | C | L | S | H | M | F | 12 | 7014 |
| 49 | F | T | V | M | E | S | S | V | L | L | 12 | 7015 |
| 52 | M | E | S | S | V | L | L | A | M | A | 12 | 7016 |
| 56 | V | L | L | A | M | A | F | D | R | F | 12 | 7017 |
| 65 | F | V | A | V | S | N | P | L | R | Y | 12 | 7018 |
| 87 | G | V | A | S | V | I | R | G | L | L | 12 | 7019 |
| 107 | R | L | S | Y | C | H | S | Q | V | L | 12 | 7020 |
| 111 | C | H | S | Q | V | L | H | H | S | Y | 12 | 7021 |
| 113 | S | Q | V | L | H | H | S | Y | C | Y | 12 | 7022 |
| 120 | Y | C | Y | H | P | D | V | M | K | L | 12 | 7023 |
| 133 | D | T | R | I | N | S | A | V | G | L | 12 | 7024 |
| 137 | N | S | A | V | G | L | T | A | M | F | 12 | 7025 |
| 146 | F | S | T | V | G | V | D | L | L | L | 12 | 7026 |
| 148 | T | V | G | V | D | L | L | L | I | L | 12 | 7027 |
| 153 | L | L | L | I | L | L | S | Y | V | L | 12 | 7028 |
| 155 | L | I | L | L | S | Y | V | L | I | I | 12 | 7029 |
| 173 | P | E | E | R | K | E | T | F | S | T | 12 | 7030 |
| 177 | K | E | T | F | S | T | C | V | S | H | 12 | 7031 |
| 183 | C | V | S | H | I | V | A | F | A | I | 12 | 7032 |
| 232 | V | I | Y | S | V | K | T | K | Q | I | 12 | 7033 |
| 48 | F | F | T | V | M | E | S | S | V | L | 11 | 7034 |
| 68 | V | S | N | P | L | R | Y | A | M | I | 11 | 7035 |
| 184 | V | S | H | I | V | A | F | A | I | Y | 11 | 7036 |
| 186 | H | I | V | A | F | A | I | Y | Y | I | 11 | 7037 |
| 237 | K | T | K | Q | I | R | R | A | V | I | 11 | 7038 |
| 8 | L | S | A | T | D | L | G | L | S | I | 10 | 7039 |
| 17 | I | S | T | L | V | T | M | L | S | I | 10 | 7040 |
| 31 | R | E | I | S | F | N | A | C | L | S | 10 | 7041 |
| 36 | F | N | A | C | L | S | H | M | F | F | 10 | 7042 |
| 37 | N | A | C | L | S | H | M | F | F | I | 10 | 7043 |
| 83 | I | A | Q | I | G | V | A | S | V | I | 10 | 7044 |
| 214 | H | T | M | I | A | N | T | Y | L | L | 10 | 7045 |
| 74 | Y | A | M | I | L | T | D | S | R | I | 9 | 7046 |
| 127 | M | K | L | S | C | T | D | T | R | I | 9 | 7047 |
| 209 | Q | A | P | A | Y | V | H | T | M | I | 9 | 7048 |
| 67 | A | V | S | N | P | L | R | Y | A | M | 8 | 7049 |
| 75 | A | M | I | L | T | D | S | R | I | A | 8 | 7050 |
| 84 | A | Q | I | G | V | A | S | V | I | R | 8 | 7051 |
| 59 | A | M | A | F | D | R | F | V | A | V | 7 | 7052 |
| 61 | A | F | D | R | F | V | A | V | S | N | 7 | 7053 |
| 81 | S | R | I | A | Q | I | G | V | A | S | 7 | 7054 |
| 90 | S | V | I | R | G | L | L | M | L | T | 7 | 7055 |
| 150 | G | V | D | L | L | L | I | L | L | S | 7 | 7056 |
| 170 | V | A | S | P | E | E | R | K | E | T | 7 | 7057 |
| 196 | P | L | I | S | L | S | I | V | H | R | 7 | 7058 |
| 208 | K | Q | A | P | A | Y | V | H | T | M | 7 | 7059 |
| 244 | A | V | I | K | I | L | H | S | K | E | 7 | 7060 |
| 2 | Y | Y | F | L | S | M | L | S | A | T | 6 | 7061 |
| 10 | A | T | D | L | G | L | S | I | S | T | 6 | 7062 |
| 76 | M | I | L | T | D | S | R | I | A | Q | 6 | 7063 |
| 121 | C | Y | H | P | D | V | M | K | L | S | 6 | 7064 |
| 130 | S | C | T | D | T | R | I | N | S | A | 6 | 7065 |
| 134 | T | R | I | N | S | A | V | G | L | T | 6 | 7066 |
| 162 | L | I | R | T | V | L | S | V | A | V | 6 | 7067 |
| 212 | A | Y | V | H | T | M | I | A | N | T | 6 | 7068 |
| 235 | S | V | K | T | K | Q | I | R | R | A | 6 | 7069 |
| 16 | S | I | S | T | L | V | T | M | L | S | 5 | 7070 |
| 30 | N | V | R | E | I | S | F | N | A | C | 5 | 7071 |
| 38 | C | L | S | H | M | F | F | I | K | F | 5 | 7072 |
| 44 | F | F | I | K | F | F | T | V | M | E | 5 | 7073 |
| 60 | M | A | F | D | R | F | V | A | V | S | 5 | 7074 |
| 70 | N | P | L | R | Y | A | M | I | L | T | 5 | 7075 |
| 71 | P | L | R | Y | A | M | I | L | T | D | 5 | 7076 |
| 100 | P | M | V | A | L | L | I | R | L | S | 5 | 7077 |
| 157 | L | L | S | Y | V | L | I | I | R | T | 5 | 7078 |
| 158 | L | S | Y | V | L | I | I | R | T | V | 5 | 7079 |
| 161 | V | L | I | I | R | T | V | L | S | V | 5 | 7080 |
| 190 | F | A | I | Y | Y | I | P | L | I | S | 5 | 7081 |
| 200 | L | S | I | V | H | R | F | G | K | Q | 5 | 7082 |
| 227 | P | L | M | N | P | V | I | Y | S | V | 5 | 7083 |
| 230 | N | P | V | I | Y | S | V | K | T | K | 5 | 7084 |
| 5 | L | S | M | L | S | A | T | D | L | G | 4 | 7085 |
| 13 | L | G | L | S | I | S | T | L | V | T | 4 | 7086 |
| 14 | G | L | S | I | S | T | L | V | T | M | 4 | 7087 |
| 23 | M | L | S | I | F | W | F | N | V | R | 4 | 7088 |
| 24 | L | S | I | F | W | F | N | V | R | E | 4 | 7089 |
| 33 | E | I | S | F | N | A | C | L | S | H | 4 | 7090 |
| 34 | I | S | F | N | A | C | L | S | H | M | 4 | 7091 |
| 42 | H | M | F | F | I | K | F | F | T | V | 4 | 7092 |
| 43 | M | F | F | I | K | F | F | T | V | M | 4 | 7093 |
| 47 | K | F | F | T | V | M | E | S | S | V | 4 | 7094 |
| 50 | T | V | M | E | S | S | V | L | L | A | 4 | 7095 |
| 51 | V | M | E | S | S | V | L | L | A | M | 4 | 7096 |
| 55 | S | V | L | L | A | M | A | F | D | R | 4 | 7097 |
| 80 | S | R | I | A | Q | I | G | V | A | S | 4 | 7098 |
| 103 | A | L | L | I | R | L | S | Y | C | H | 4 | 7099 |
| 104 | L | L | I | R | L | S | Y | C | H | S | 4 | 7100 |
| 128 | K | L | S | C | T | D | T | R | I | N | 4 | 7101 |
| 131 | C | T | D | T | R | I | N | S | A | V | 4 | 7102 |
| 136 | I | N | S | A | V | G | L | T | A | M | 4 | 7103 |
| 139 | A | V | G | L | T | A | M | F | S | T | 4 | 7104 |
| 140 | V | G | L | T | A | M | F | S | T | V | 4 | 7105 |
| 160 | Y | V | L | I | I | R | T | V | L | S | 4 | 7106 |
| 163 | I | I | R | T | V | L | S | V | A | S | 4 | 7107 |
| 192 | I | Y | Y | I | P | L | I | S | L | S | 4 | 7108 |
| 201 | S | I | V | H | R | F | G | K | Q | A | 4 | 7109 |
| 210 | A | P | A | Y | V | H | T | M | I | A | 4 | 7110 |
| 221 | T | Y | L | L | I | S | P | L | M | N | 4 | 7111 |
| 223 | L | L | I | S | P | L | M | N | P | V | 4 | 7112 |
| 226 | S | P | L | M | N | P | V | I | Y | S | 4 | 7113 |
| 228 | L | M | N | P | V | I | Y | S | V | K | 4 | 7114 |
| 231 | P | V | I | Y | S | V | K | T | K | Q | 4 | 7115 |
| 236 | V | K | T | K | Q | I | R | R | A | V | 4 | 7116 |
| 242 | R | R | A | V | I | K | I | L | H | S | 4 | 7117 |
| 7 | M | L | S | A | T | D | L | G | L | S | 3 | 7118 |
| 9 | S | A | T | D | L | G | L | S | I | S | 3 | 7119 |
| 21 | V | T | M | L | S | I | F | W | F | N | 3 | 7120 |
| 28 | W | F | N | V | R | E | I | S | F | N | 3 | 7121 |
| 58 | L | A | M | A | F | D | R | F | V | A | 3 | 7122 |
| 79 | T | D | S | R | I | A | Q | I | G | V | 3 | 7123 |
| 88 | V | A | S | V | I | R | G | L | L | M | 3 | 7124 |
| 91 | V | I | R | G | L | L | M | L | T | P | 3 | 7125 |
| 93 | R | G | L | L | M | L | T | P | M | V | 3 | 7126 |
| 94 | G | L | L | M | L | T | P | M | V | A | 3 | 7127 |
| 98 | L | T | P | M | V | A | L | L | I | R | 3 | 7128 |
| 102 | V | A | L | L | I | R | L | S | Y | C | 3 | 7129 |
| 109 | S | Y | C | H | S | Q | V | L | H | H | 3 | 7130 |
| 122 | Y | H | P | D | V | M | K | L | S | C | 3 | 7131 |
| 126 | V | M | K | L | S | C | T | D | T | R | 3 | 7132 |
| 129 | L | S | C | T | D | T | R | I | N | S | 3 | 7133 |
| 138 | S | A | V | G | L | T | A | M | F | S | 3 | 7134 |
| 143 | T | A | M | F | S | T | V | G | V | D | 3 | 7135 |
| 152 | D | L | L | L | I | L | L | S | Y | V | 3 | 7136 |
| 156 | I | L | L | S | Y | V | L | I | I | R | 3 | 7137 |
| 169 | S | V | A | S | P | E | E | R | K | E | 3 | 7138 |
| 176 | R | K | E | T | F | S | T | C | V | S | 3 | 7139 |
| 179 | T | F | S | T | C | V | S | H | I | V | 3 | 7140 |
| 19 | Y | I | P | L | I | S | L | S | I | V | 3 | 7141 |
| 195 | I | P | L | I | S | L | S | I | V | H | 3 | 7142 |
| 199 | S | L | S | I | V | H | R | F | G | K | 3 | 7143 |
| 202 | I | V | H | R | F | G | K | Q | A | P | 3 | 7144 |
| 211 | P | A | Y | V | H | T | M | I | A | N | 3 | 7145 |
| 21 | M | I | A | N | T | Y | L | L | I | S | 3 | 7146 |
| 218 | I | A | N | T | Y | L | L | I | S | P | 3 | 7147 |
| 220 | N | T | Y | L | L | I | S | P | L | M | 3 | 7148 |
| 229 | M | N | P | V | I | Y | S | V | K | T | 3 | 7149 |
| 3 | Y | F | L | S | M | L | S | A | T | D | 2 | 7150 |
| 12 | D | L | G | L | S | I | S | T | L | V | 2 | 7151 |
| 41 | S | H | M | F | F | I | K | F | F | T | 2 | 7152 |

TABLE XIXB-continued part 1

| Pos | 1 | 2 | 3 | 4 | 5 | 6 | 7 | 8 | 9 | 0 | score | SEQ ID |
|---|---|---|---|---|---|---|---|---|---|---|---|---|
| 46 | I | K | F | F | T | V | M | E | S | S | 2 | 7153 |
| 54 | S | S | V | L | L | A | M | A | F | D | 2 | 7154 |
| 66 | V | A | V | S | N | P | L | R | Y | A | 2 | 7155 |
| 78 | L | T | D | S | R | I | A | Q | I | G | 2 | 7156 |
| 85 | Q | I | G | V | A | S | V | I | R | G | 2 | 7157 |
| 92 | I | R | G | L | L | M | L | T | P | M | 2 | 7158 |
| 105 | L | I | R | L | S | Y | C | H | S | Q | 2 | 7159 |
| 106 | I | R | L | S | Y | C | H | S | Q | V | 2 | 7160 |
| 108 | L | S | Y | C | H | S | Q | V | L | H | 2 | 7161 |
| 110 | Y | C | H | S | Q | V | L | H | H | S | 2 | 7162 |
| 118 | H | S | Y | C | Y | H | P | D | V | M | 2 | 7163 |
| 119 | S | Y | C | Y | H | P | D | V | M | K | 2 | 7164 |
| 123 | H | P | D | V | M | K | L | S | C | T | 2 | 7165 |
| 132 | T | D | T | R | I | N | S | A | V | G | 2 | 7166 |
| 135 | R | I | N | S | A | V | G | L | T | A | 2 | 7167 |
| 142 | L | T | A | M | F | S | T | V | G | V | 2 | 7168 |
| 165 | R | T | V | L | S | V | A | S | P | E | 2 | 7169 |
| 167 | V | L | S | V | A | S | P | E | E | R | 2 | 7170 |
| 175 | E | R | K | E | T | F | S | T | C | V | 2 | 7171 |
| 180 | F | S | T | C | V | S | G | I | V | A | 2 | 7172 |
| 198 | I | S | L | S | I | V | H | R | F | G | 2 | 7173 |
| 206 | F | G | K | Q | A | P | A | Y | V | G | 2 | 7174 |
| 222 | Y | L | L | I | S | P | L | M | N | P | 2 | 7175 |
| 238 | T | K | Q | I | R | R | A | V | I | K | 2 | 7176 |
| 241 | I | R | R | A | V | I | K | I | L | H | 2 | 7177 |
| 243 | R | A | V | I | K | I | L | H | S | K | 2 | 7178 |
| 245 | V | I | K | I | L | H | S | K | E | T | 2 | 7179 |
| 1 | M | Y | Y | F | L | S | M | L | S | A | 1 | 7180 |
| 22 | M | L | S | I | F | W | F | N | V | L | 1 | 7181 |
| 26 | I | F | W | F | N | V | R | E | I | S | 1 | 7182 |
| 29 | F | N | V | R | E | I | S | F | N | A | 1 | 7183 |
| 45 | F | I | K | F | F | T | V | M | E | S | 1 | 7184 |
| 57 | L | L | A | M | A | F | D | R | F | V | 1 | 7185 |
| 62 | F | D | R | F | V | A | V | S | N | P | 1 | 7186 |
| 64 | R | F | V | A | V | S | N | P | L | R | 1 | 7187 |
| 72 | L | R | Y | A | M | I | L | T | D | S | 1 | 7188 |
| 73 | R | Y | A | M | I | L | T | D | S | R | 1 | 7189 |
| 82 | R | I | A | Q | I | G | V | A | S | V | 1 | 7190 |
| 114 | Q | V | L | H | H | S | Y | C | Y | H | 1 | 7191 |
| 116 | L | H | H | S | Y | C | Y | H | P | D | 1 | 7192 |
| 117 | H | H | S | Y | C | Y | H | P | D | V | 1 | 7193 |
| 124 | P | D | V | M | K | S | C | T | D | 1 | 7194 |

TABLE XIXB part 2

| Pos | 1 | 2 | 3 | 4 | 5 | 6 | 7 | 8 | 9 | 0 | score | SEQ ID |
|---|---|---|---|---|---|---|---|---|---|---|---|---|

HLA-A*0201 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 58 | S | L | H | E | P | M | Y | Y | F | L | 25 | 7195 |
| 8 | N | I | T | S | T | I | I | F | L | L | 21 | 7196 |
| 43 | L | L | G | N | S | L | I | L | F | A | 21 | 7197 |
| 5 | T | L | Q | N | I | T | S | T | I | I | 20 | 7198 |
| 9 | I | T | S | T | I | I | F | L | L | T | 20 | 7199 |
| 15 | I | F | L | L | T | G | V | P | G | L | 20 | 7200 |
| 17 | L | L | T | G | V | P | G | L | E | A | 20 | 7201 |
| 42 | A | L | L | G | N | S | L | I | L | F | 20 | 7202 |
| 31 | I | S | I | P | F | C | F | L | S | V | 19 | 7203 |
| 39 | S | V | T | A | L | L | G | N | S | L | 18 | 7204 |
| 12 | T | S | I | I | F | L | L | T | G | V | 17 | 7205 |
| 32 | S | I | P | F | C | F | L | S | V | T | 17 | 7206 |
| 37 | F | L | S | V | T | A | L | L | G | N | 17 | 7207 |
| 41 | T | A | L | L | G | N | S | L | I | L | 17 | 7208 |
| 50 | L | F | A | T | I | T | Q | P | S | L | 17 | 7209 |
| 47 | S | L | I | L | F | A | T | I | T | Q | 16 | 7210 |
| 40 | V | T | A | L | L | G | N | S | L | I | 15 | 7211 |
| 48 | L | I | L | F | A | T | I | T | Q | P | 15 | 7212 |
| 35 | F | C | F | L | S | V | T | A | L | L | 14 | 7213 |
| 53 | T | I | T | Q | P | S | L | H | E | P | 14 | 7214 |
| 1 | F | I | T | S | T | L | Q | N | I | T | 13 | 7215 | part 2

| Pos | 1 | 2 | 3 | 4 | 5 | 6 | 7 | 8 | 9 | 0 | score | SEQ ID |
|---|---|---|---|---|---|---|---|---|---|---|---|---|
| 11 | S | T | S | I | I | F | L | L | T | G | 13 | 7216 |
| 14 | I | I | F | L | L | T | G | V | P | G | 13 | 7217 |
| 16 | F | L | L | T | G | V | P | G | L | E | 13 | 7218 |
| 24 | L | E | A | F | H | T | W | I | S | I | 13 | 7219 |
| 45 | G | N | S | L | I | L | F | A | T | I | 13 | 7220 |
| 49 | I | L | F | A | T | I | T | Q | P | S | 13 | 7221 |
| 29 | T | W | I | S | I | P | F | C | F | L | 12 | 7222 |
| 44 | L | G | N | S | L | I | L | F | A | T | 12 | 7223 |
| 54 | I | T | Q | P | S | L | H | E | P | M | 12 | 7224 |
| 6 | L | Q | N | I | T | S | T | S | I | T | 11 | 7225 |
| 13 | S | I | I | F | L | L | T | G | V | P | 11 | 7226 |
| 18 | L | T | G | V | P | G | L | E | A | F | 11 | 7227 |
| 20 | G | V | P | G | L | E | A | F | H | T | 11 | 7228 |
| 33 | I | P | F | C | F | L | S | V | T | A | 11 | 7229 |
| 34 | P | F | C | F | L | S | V | T | A | L | 11 | 7230 |
| 61 | E | P | M | Y | Y | F | L | S | M | L | 11 | 7231 |
| 4 | S | T | L | Q | N | I | T | S | T | S | 10 | 7232 |
| 23 | G | L | E | A | F | H | T | W | I | S | 10 | 7233 |
| 3 | T | S | T | L | Q | N | I | T | S | T | 9 | 7234 |
| 22 | P | G | L | E | A | F | H | T | W | I | 9 | 7235 |
| 52 | A | T | I | T | Q | P | S | L | H | E | 9 | 7236 |
| 2 | I | T | S | T | L | Q | N | I | T | S | 8 | 7237 |
| 30 | W | I | S | I | P | F | C | F | L | S | 8 | 7238 |
| 60 | H | E | P | M | Y | Y | F | L | S | M | 7 | 7239 |
| 25 | E | A | F | H | T | W | I | S | I | P | 6 | 7240 |
| 38 | L | S | V | T | A | L | L | G | N | S | 6 | 7241 |
| 46 | N | S | L | I | L | F | A | T | I | T | 6 | 7242 |
| 27 | F | H | T | W | I | S | I | P | F | C | 5 | 7243 |
| 28 | H | T | W | I | S | I | P | F | C | F | 5 | 7244 |
| 62 | P | M | Y | Y | F | L | S | M | L | S | 5 | 7245 |
| 10 | T | S | T | I | I | F | L | L | T | 4 | 7246 |
| 19 | T | G | V | P | G | L | E | A | F | H | 4 | 7247 |
| 21 | V | P | G | L | E | A | F | H | T | W | 4 | 7248 |
| 51 | F | A | T | I | T | Q | P | S | L | H | 4 | 7249 |
| 36 | C | F | L | S | V | T | A | L | L | G | 3 | 7250 |
| 59 | L | H | E | P | M | Y | Y | F | L | S | 3 | 7251 |
| 7 | Q | N | I | T | S | T | I | I | F | 2 | 7252 |
| 26 | A | F | H | T | W | I | S | I | P | F | 2 | 7253 |
| 55 | T | Q | P | S | L | H | E | P | M | Y | 1 | 7254 |

HLA-A*0202 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 24 | L | E | A | F | H | T | W | I | S | I | 3 | 7255 |
| 40 | V | T | A | L | L | G | N | S | L | I | 3 | 7256 |
| 50 | L | F | A | T | I | T | Q | P | S | L | 3 | 7257 |
| 25 | E | A | F | H | T | W | I | S | I | P | 2 | 7258 |
| 41 | T | A | L | L | G | N | S | L | I | L | 2 | 7259 |
| 51 | F | A | T | I | T | Q | P | S | L | H | 2 | 7260 |
| 26 | A | F | H | T | W | I | S | I | P | F | 1 | 7261 |
| 42 | A | L | L | G | N | S | L | I | L | F | 1 | 7262 |
| 52 | A | T | I | T | Q | P | S | L | H | E | 1 | 7263 |

HLA-A*0203 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 17 | L | L | T | G | V | P | G | L | E | A | 10 | 7264 |
| 33 | I | P | F | C | F | L | S | V | T | A | 10 | 7265 |
| 43 | L | L | G | N | S | L | I | L | F | A | 10 | 7266 |
| 18 | L | T | G | V | P | G | L | E | A | F | 9 | 7267 |
| 34 | P | F | C | F | L | S | V | T | A | L | 9 | 7268 |
| 44 | L | G | N | S | L | I | L | F | A | T | 9 | 7269 |
| 19 | T | G | V | P | G | L | E | A | F | H | 8 | 7270 |
| 35 | F | C | F | L | S | V | T | A | L | L | 8 | 7271 |
| 45 | G | N | S | L | I | L | F | A | T | I | 8 | 7272 |

HLA-A1 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 31 | I | S | I | P | F | C | F | L | S | V | 17 | 7273 |
| 55 | T | Q | P | S | L | H | E | P | M | Y | 16 | 7274 |
| 59 | L | H | E | P | M | Y | Y | F | L | S | 16 | 7275 |
| 10 | T | S | T | I | I | F | L | L | T | 15 | 7276 |
| 56 | Q | P | S | L | H | E | P | M | Y | Y | 15 | 7277 |
| 11 | S | T | S | I | I | F | L | L | T | G | 14 | 7278 |
| 52 | A | T | I | T | Q | P | S | L | H | E | 13 | 7279 |
| 2 | I | T | S | T | L | Q | N | I | T | S | 11 | 7280 |
| 23 | G | L | E | A | F | H | T | W | I | S | 11 | 7281 |

TABLE XIXB-continued part 2

| Pos | 1 | 2 | 3 | 4 | 5 | 6 | 7 | 8 | 9 | 0 | score | SEQ ID |
|---|---|---|---|---|---|---|---|---|---|---|---|---|
| 40 | V | T | A | L | L | G | N | S | L | I | 10 | 7282 |
| 54 | I | T | Q | P | S | L | H | E | P | M | 10 | 7283 |
| 17 | L | L | T | G | V | P | G | L | E | A | 9 | 7284 |
| 42 | A | L | L | G | N | S | L | I | L | F | 9 | 7285 |
| 60 | H | E | P | M | Y | Y | F | L | S | M | 9 | 7286 |
| 4 | S | T | L | Q | N | I | T | S | T | S | 8 | 7287 |
| 9 | I | T | S | T | S | I | I | F | L | L | 8 | 7288 |
| 36 | C | F | L | S | V | T | A | L | L | G | 8 | 7289 |
| 37 | F | L | S | V | T | A | L | L | G | N | 8 | 7290 |
| 43 | L | L | G | N | S | L | I | L | F | A | 7 | 7291 |
| 47 | S | L | I | L | F | A | T | I | T | Q | 7 | 7292 |
| 18 | L | T | G | V | P | G | L | E | A | F | 6 | 7293 |
| 28 | H | T | W | I | S | I | P | F | C | F | 6 | 7294 |
| 41 | T | A | L | L | G | N | S | L | I | L | 6 | 7295 |
| 26 | A | F | H | T | W | I | S | I | P | F | 5 | 7296 |
| 3 | T | S | T | L | Q | N | I | T | S | T | 4 | 7297 |
| 7 | Q | N | I | T | S | T | S | I | I | F | 4 | 7298 |
| 8 | N | I | T | S | T | S | I | I | F | L | 4 | 7299 |
| 12 | T | S | I | I | F | L | L | T | G | V | 4 | 7300 |
| 16 | F | L | L | T | G | V | P | G | L | E | 4 | 7301 |
| 19 | T | G | V | P | G | L | E | A | F | H | 4 | 7302 |
| 21 | V | P | G | L | E | A | F | H | T | W | 4 | 7303 |
| 24 | L | E | A | F | H | T | W | I | S | I | 4 | 7304 |
| 38 | L | S | V | T | A | L | L | G | N | S | 4 | 7305 |
| 46 | N | S | L | I | L | F | A | T | I | T | 4 | 7306 |
| 57 | P | S | L | H | E | P | M | Y | Y | F | 4 | 7307 |
| 13 | S | I | I | F | L | L | T | G | V | P | 3 | 7308 |
| 29 | T | W | I | S | I | P | F | C | F | L | 3 | 7309 |
| 32 | S | I | P | F | C | F | L | S | V | T | 3 | 7310 |
| 35 | F | C | F | L | S | V | T | A | L | L | 3 | 7311 |
| 39 | S | V | T | A | L | L | G | N | S | L | 3 | 7312 |
| 45 | G | N | S | L | I | L | F | A | T | I | 3 | 7313 |
| 51 | F | A | T | I | T | Q | P | S | L | H | 3 | 7314 |
| 58 | S | L | H | E | P | M | Y | Y | F | L | 3 | 7315 |
| 30 | W | I | S | I | P | F | C | F | L | S | 2 | 7316 |
| 62 | P | M | Y | Y | F | L | S | M | L | S | 2 | 7317 |
| 1 | F | I | T | S | T | L | Q | N | I | T | 1 | 7318 |
| 5 | T | L | Q | N | I | T | S | T | S | I | 1 | 7319 |
| 14 | I | I | F | L | L | T | G | V | P | G | 1 | 7320 |
| 15 | I | F | L | L | T | G | V | P | G | L | 1 | 7321 |
| 20 | V | P | G | L | E | A | F | H | T | I | 1 | 7322 |
| 27 | F | H | T | W | I | S | I | P | F | C | 1 | 7323 |
| 34 | P | F | C | F | L | S | V | T | A | L | 1 | 7324 |
| 49 | I | L | F | A | T | I | T | Q | P | S | 1 | 7325 |
| 61 | E | P | M | Y | Y | F | L | S | M | L | 1 | 7326 |

HLA-A26 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 18 | L | T | G | V | P | G | L | E | A | F | 25 | 7327 |
| 42 | A | L | L | G | N | S | L | I | L | F | 24 | 7328 |
| 8 | N | I | T | S | T | S | I | I | F | L | 23 | 7329 |
| 9 | I | T | S | T | S | I | I | F | L | L | 22 | 7330 |
| 58 | S | L | H | E | P | M | Y | Y | F | L | 22 | 7331 |
| 15 | I | F | L | L | T | G | V | P | G | L | 20 | 7332 |
| 28 | H | T | W | I | S | I | P | F | C | F | 20 | 7333 |
| 54 | I | T | Q | P | S | L | H | E | P | M | 20 | 7334 |
| 61 | E | P | M | Y | Y | F | L | S | M | L | 20 | 7335 |
| 34 | P | F | C | F | L | S | V | T | A | L | 19 | 7336 |
| 39 | S | V | T | A | L | L | G | N | S | L | 19 | 7337 |
| 50 | L | F | A | T | I | T | Q | P | S | L | 17 | 7338 |
| 26 | A | F | H | T | W | I | S | I | P | F | 16 | 7339 |
| 32 | S | I | P | F | C | F | L | S | V | T | 16 | 7340 |
| 53 | T | I | T | Q | P | S | L | H | E | P | 16 | 7341 |
| 29 | T | W | I | S | I | P | F | C | F | L | 15 | 7342 |
| 48 | L | I | L | F | A | T | I | T | Q | P | 15 | 7343 |
| 11 | S | T | S | I | I | F | L | L | T | G | 14 | 7344 |
| 20 | V | P | G | L | E | A | F | H | T | W | 14 | 7345 |
| 55 | T | Q | P | S | L | H | E | P | M | Y | 14 | 7346 |
| 57 | P | S | L | H | E | P | M | Y | Y | F | 14 | 7347 |
| 60 | H | E | P | M | Y | Y | F | L | S | M | 14 | 7348 |
| 14 | I | I | F | L | L | T | G | V | P | G | 13 | 7349 |
| 25 | E | A | F | H | T | W | I | S | I | P | 13 | 7350 |
| 37 | F | L | S | V | T | A | L | L | G | N | 13 | 7351 |
| 52 | A | T | I | T | Q | P | S | L | H | E | 13 | 7352 |
| 4 | S | T | L | Q | N | I | T | S | T | S | 12 | 7353 |
| 7 | Q | N | I | T | S | T | S | I | I | F | 12 | 7354 |
| 13 | S | I | I | F | L | L | T | G | V | P | 12 | 7355 |
| 40 | V | T | A | L | L | G | N | S | L | I | 12 | 7356 |
| 43 | L | L | G | N | S | L | I | L | F | A | 12 | 7357 |
| 1 | F | I | T | S | T | L | Q | N | I | T | 11 | 7358 |
| 17 | L | L | T | G | V | P | G | L | E | A | 11 | 7359 |
| 35 | F | C | F | L | S | V | T | A | L | L | 11 | 7360 |
| 49 | I | L | F | A | T | I | T | Q | P | S | 11 | 7361 |
| 56 | Q | P | S | L | H | E | P | M | Y | Y | 11 | 7362 |
| 2 | I | T | S | T | L | Q | N | I | T | S | 10 | 7363 |
| 30 | W | I | S | I | P | F | C | F | L | S | 10 | 7364 |
| 47 | S | L | I | L | F | A | T | I | T | Q | 10 | 7365 |
| 5 | T | L | Q | N | I | T | S | T | S | I | 9 | 7366 |
| 31 | I | S | I | P | F | C | F | L | S | V | 9 | 7367 |
| 16 | F | L | L | T | G | V | P | G | L | E | 8 | 7368 |
| 23 | G | L | E | A | F | H | T | W | I | S | 8 | 7369 |
| 41 | T | A | L | L | G | N | S | L | I | L | 8 | 7370 |
| 12 | T | S | I | I | F | L | L | T | G | V | 7 | 7371 |
| 36 | C | F | L | S | V | T | A | L | L | G | 7 | 7372 |
| 44 | L | G | N | S | L | I | L | F | A | T | 6 | 7373 |
| 59 | L | H | E | P | M | Y | Y | F | L | S | 6 | 7374 |
| 3 | T | S | T | L | Q | N | I | T | S | T | 5 | 7375 |
| 10 | T | S | T | S | I | I | F | L | L | T | 5 | 7376 |
| 27 | F | H | T | W | I | S | I | P | F | C | 5 | 7377 |
| 38 | L | S | V | T | A | L | L | G | N | S | 5 | 7378 |
| 45 | G | N | S | L | I | L | F | A | T | I | 5 | 8903 |
| 21 | V | P | G | L | E | A | F | H | T | W | 4 | 8904 |
| 19 | T | G | V | P | G | L | E | A | F | H | 3 | 8905 |
| 33 | I | P | F | C | F | L | S | V | T | A | 3 | 8906 |
| 22 | P | G | L | E | A | F | H | T | W | I | 2 | 8907 |
| 2 | L | E | A | F | H | T | W | I | S | I | 2 | 8908 |
| 6 | L | Q | N | I | T | S | T | S | I | I | 1 | 8909 |
| 51 | F | A | T | I | T | Q | P | S | L | H | 1 | 8910 |
| 62 | P | M | Y | Y | F | L | S | M | L | S | 1 | 8911 |

HLA-A3 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 42 | A | L | L | G | N | S | L | I | L | F | 21 | 7379 |
| 47 | S | L | I | L | F | A | T | I | T | Q | 19 | 7380 |
| 14 | I | I | F | L | L | T | G | V | P | G | 18 | 7381 |
| 17 | L | L | T | G | V | P | G | L | E | A | 18 | 7382 |
| 39 | S | V | T | A | L | L | G | N | S | L | 18 | 7383 |
| 13 | S | I | I | F | L | L | T | G | V | P | 17 | 7384 |
| 32 | S | I | P | F | C | F | L | S | V | T | 16 | 7385 |
| 20 | V | P | G | L | E | A | F | H | T | W | 15 | 7386 |
| 5 | T | L | Q | N | I | T | S | T | S | I | 14 | 7387 |
| 16 | F | L | L | T | G | V | P | G | L | E | 14 | 7388 |
| 43 | L | L | G | N | S | L | I | L | F | A | 14 | 7389 |
| 48 | L | I | L | F | A | T | I | T | Q | P | 14 | 7390 |
| 49 | I | L | F | A | T | I | T | Q | P | S | 14 | 7391 |
| 31 | I | S | I | P | F | C | F | L | S | V | 13 | 7392 |
| 37 | F | L | S | V | T | A | L | L | G | N | 13 | 7393 |
| 23 | G | L | E | A | F | H | T | W | I | S | 12 | 7394 |
| 58 | S | L | H | E | P | M | Y | Y | F | L | 12 | 7395 |
| 56 | Q | P | S | L | H | E | P | M | Y | Y | 11 | 7396 |
| 4 | S | T | L | Q | N | I | T | S | T | S | 10 | 7397 |
| 19 | T | G | V | P | G | L | E | A | F | H | 10 | 7398 |
| 33 | I | P | F | C | F | L | S | V | T | A | 10 | 7399 |
| 7 | Q | N | I | T | S | T | S | I | I | F | 9 | 7400 |
| 11 | S | T | S | I | I | F | L | L | T | G | 9 | 7401 |
| 30 | W | I | S | I | P | F | C | F | L | S | 9 | 7402 |
| 51 | F | A | T | I | T | Q | P | S | L | H | 9 | 7403 |
| 52 | A | T | I | T | Q | P | S | L | H | E | 9 | 7404 |
| 1 | F | I | T | S | T | L | Q | N | I | T | 8 | 7405 |
| 8 | N | I | T | S | T | S | I | I | F | L | 8 | 7406 |
| 36 | C | F | L | S | V | T | A | L | L | G | 8 | 7407 |
| 45 | G | N | S | L | I | L | F | A | T | I | 8 | 7408 |
| 53 | T | I | T | Q | P | S | L | H | E | P | 8 | 7409 |
| 26 | A | F | H | T | W | I | S | I | P | F | 7 | 7410 |
| 46 | N | S | L | I | L | F | A | T | I | T | 7 | 7411 |
| 55 | T | Q | P | S | L | H | E | P | M | Y | 7 | 7412 |
| 2 | I | T | S | T | L | Q | N | I | T | S | 6 | 7413 |
| 28 | H | T | W | I | S | I | P | F | C | F | 6 | 7414 |
| 41 | T | A | L | L | G | N | S | L | I | L | 6 | 7415 |
| 57 | P | S | L | H | E | P | M | Y | Y | F | 6 | 7416 |

TABLE XIXB-continued part 2

| Pos | 1 | 2 | 3 | 4 | 5 | 6 | 7 | 8 | 9 | 0 | score | SEQ ID |
|---|---|---|---|---|---|---|---|---|---|---|---|---|
| 12 | T | S | I | I | F | L | L | T | G | V | 5 | 7417 |
| 15 | I | F | L | L | T | G | V | P | G | L | 5 | 7418 |
| 18 | L | T | G | V | P | G | L | E | A | F | 5 | 7419 |
| 21 | V | P | G | L | E | A | F | H | T | W | 5 | 7420 |
| 22 | P | G | L | E | A | F | H | T | W | I | 5 | 7421 |
| 40 | V | T | A | L | L | G | N | S | L | I | 5 | 7422 |
| 54 | I | T | Q | P | S | L | H | E | P | M | 5 | 7423 |
| 60 | H | E | P | M | Y | Y | F | L | S | M | 5 | 7424 |
| 62 | P | M | Y | Y | F | L | S | M | L | S | 5 | 7425 |
| 3 | T | S | T | L | Q | N | I | T | S | T | 4 | 7426 |
| 6 | L | Q | N | I | T | S | T | S | I | I | 4 | 7427 |
| 35 | F | C | F | L | S | V | T | A | L | L | 4 | 7428 |
| 61 | E | P | M | Y | Y | F | L | S | M | L | 4 | 7429 |
| 10 | T | S | T | S | I | I | F | L | L | T | 3 | 7430 |
| 2 | L | E | A | F | H | T | W | I | S | I | 3 | 7431 |
| 25 | E | A | F | H | T | W | I | S | I | P | 3 | 7432 |
| 29 | T | W | I | S | I | P | F | C | F | L | 3 | 7433 |
| 50 | L | F | A | T | I | T | Q | P | S | L | 3 | 7434 |
| 59 | L | H | E | P | M | Y | Y | F | L | S | 3 | 7435 |
| 9 | I | T | S | T | S | I | T | F | L | L | 2 | 7436 |
| 34 | P | F | C | F | L | S | V | T | A | L | 2 | 7437 |
| 38 | L | S | V | T | A | L | L | G | N | S | 1 | 7438 |
| 44 | L | G | N | S | L | I | L | F | A | T | 1 | 7439 |

HLA-B*0702 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 61 | E | P | M | Y | Y | F | L | S | M | L | 22 | 7440 |
| 33 | I | P | F | C | F | L | S | V | T | A | 19 | 7441 |
| 9 | I | T | S | T | S | I | I | F | L | L | 13 | 7442 |
| 15 | I | F | L | L | T | G | V | P | G | L | 13 | 7443 |
| 34 | P | F | C | F | L | S | V | T | A | L | 13 | 7444 |
| 21 | V | P | G | L | E | A | F | H | T | W | 12 | 7445 |
| 29 | T | W | I | S | I | P | F | C | F | L | 12 | 7446 |
| 35 | F | C | F | L | S | V | T | A | L | L | 12 | 7447 |
| 41 | T | A | L | L | G | N | S | L | I | L | 12 | 7448 |
| 50 | L | F | A | T | I | T | Q | P | S | L | 12 | 7449 |
| 56 | Q | P | S | L | H | E | P | M | Y | Y | 12 | 7450 |
| 8 | N | I | T | S | T | S | I | T | F | L | 11 | 7451 |
| 31 | I | S | T | P | F | C | F | L | S | V | 11 | 7452 |
| 39 | S | V | T | A | L | L | G | N | S | L | 11 | 7453 |
| 58 | S | L | H | E | P | M | Y | Y | F | L | 11 | 7454 |
| 17 | L | L | T | G | V | P | G | L | E | A | 10 | 7455 |
| 42 | A | L | L | G | N | S | L | I | L | F | 10 | 7456 |
| 43 | L | L | G | N | S | L | I | L | F | A | 10 | 7457 |
| 45 | G | N | S | L | I | L | F | A | T | I | 10 | 7458 |
| 10 | T | S | T | S | I | I | F | L | L | T | 9 | 7459 |
| 26 | A | F | H | T | W | I | S | I | P | F | 9 | 7460 |
| 54 | I | T | Q | P | S | L | H | E | P | M | 9 | 7461 |
| 60 | H | E | P | M | Y | Y | F | L | S | M | 9 | 7462 |
| 18 | L | T | G | V | P | G | L | E | A | F | 8 | 7463 |
| 20 | G | V | P | G | L | E | A | F | H | T | 8 | 7464 |
| 3 | T | S | T | L | Q | N | I | T | S | T | 7 | 7465 |
| 5 | T | L | Q | N | I | T | S | T | S | I | 7 | 7466 |
| 6 | L | Q | N | I | T | S | T | S | I | I | 7 | 7467 |
| 12 | T | S | T | I | F | L | L | T | G | V | 7 | 7468 |
| 22 | P | G | L | E | A | F | H | T | W | I | 7 | 7469 |
| 24 | L | E | A | F | H | T | W | I | S | I | 7 | 7470 |
| 32 | S | I | P | F | C | F | L | S | V | T | 7 | 7471 |
| 40 | V | T | A | L | L | G | N | S | L | I | 7 | 7472 |
| 44 | L | G | N | S | L | I | L | F | A | T | 7 | 7473 |
| 46 | N | S | L | I | L | F | A | T | I | T | 7 | 7474 |
| 1 | F | I | T | S | T | L | Q | N | I | T | 6 | 7475 |
| 7 | Q | N | I | T | S | T | S | I | I | F | 6 | 7476 |
| 28 | H | T | W | I | S | I | P | F | C | F | 6 | 7477 |
| 57 | P | S | L | H | E | P | M | Y | Y | F | 6 | 7478 |
| 11 | S | T | S | I | T | F | L | L | T | G | 4 | 7479 |
| 14 | I | I | F | L | L | T | G | V | P | G | 4 | 7480 |
| 37 | F | L | S | V | T | A | L | L | G | N | 4 | 7481 |
| 49 | I | L | F | A | T | I | T | Q | P | S | 4 | 7482 |
| 52 | A | T | I | T | Q | P | S | L | H | E | 4 | 7483 |
| 2 | I | T | S | T | L | Q | N | I | T | S | 3 | 7484 |
| 19 | T | G | V | P | G | L | E | A | F | H | 3 | 7485 |
| 13 | S | I | I | F | L | L | T | G | V | P | 2 | 7486 |
| 23 | G | L | E | A | F | H | T | W | I | S | 2 | 7487 |
| 27 | F | H | T | W | I | S | I | P | F | C | 2 | 7488 |
| 30 | W | I | S | I | P | F | C | F | L | S | 2 | 7489 |
| 36 | C | F | L | S | V | T | A | L | L | G | 2 | 7490 |
| 4 | S | T | L | Q | N | I | T | S | T | S | 1 | 7491 |
| 25 | E | A | F | H | T | W | I | S | I | P | 1 | 7492 |
| 47 | S | L | I | L | F | A | T | I | T | Q | 1 | 7493 |
| 48 | L | I | L | F | A | T | I | T | Q | P | 1 | 7494 |
| 55 | T | Q | P | S | L | H | E | P | M | Y | 1 | 7495 |
| 59 | L | H | E | P | M | Y | Y | F | L | S | 1 | 7496 |

HLA-B*4402 10-mers v.1B: 238P1B2

| Pos | 1 | 2 | 3 | 4 | 5 | 6 | 7 | 8 | 9 | 0 | score | SEQ ID |
|---|---|---|---|---|---|---|---|---|---|---|---|---|
| 24 | L | E | A | F | H | T | W | I | S | I | 19 | 7497 |
| 42 | A | L | L | G | N | S | L | I | L | F | 18 | 7498 |
| 9 | I | T | S | T | S | I | I | F | L | L | 16 | 7499 |
| 7 | Q | N | I | T | S | T | S | I | I | F | 15 | 7500 |
| 8 | N | I | T | S | T | S | I | I | F | L | 15 | 7501 |
| 26 | A | F | H | T | W | I | S | I | P | F | 15 | 7502 |
| 35 | F | C | F | L | S | V | T | A | L | L | 15 | 7503 |
| 21 | V | P | G | L | E | A | F | H | T | W | 14 | 7504 |
| 29 | T | W | I | S | I | P | F | C | F | L | 14 | 7505 |
| 61 | E | P | M | Y | Y | F | L | S | M | L | 14 | 7506 |
| 15 | I | F | L | L | T | G | V | P | G | L | 13 | 7507 |
| 18 | L | T | G | V | P | G | L | E | A | F | 13 | 7508 |
| 34 | P | F | C | F | L | S | V | T | A | L | 13 | 7509 |
| 41 | T | A | L | L | G | N | S | L | I | L | 13 | 7510 |
| 56 | Q | P | S | L | H | E | P | M | Y | Y | 13 | 7511 |
| 60 | H | E | P | M | Y | Y | F | L | S | M | 13 | 7512 |
| 39 | S | V | T | A | L | L | G | N | S | L | 12 | 7513 |
| 45 | G | N | S | L | I | L | F | A | T | I | 12 | 7514 |
| 28 | H | T | W | I | S | I | P | F | C | F | 11 | 7515 |
| 50 | L | F | A | T | I | T | Q | P | S | L | 11 | 7516 |
| 55 | T | Q | P | S | L | H | E | P | M | Y | 11 | 7517 |
| 57 | P | S | L | H | E | P | M | Y | Y | F | 11 | 7518 |
| 58 | S | L | H | E | P | M | Y | Y | F | L | 11 | 7519 |
| 40 | V | T | A | L | L | G | N | S | L | I | 10 | 7520 |
| 5 | T | L | Q | N | I | T | S | T | S | I | 9 | 7521 |
| 6 | L | Q | N | I | T | S | T | S | I | I | 9 | 7522 |
| 22 | P | G | L | E | A | F | H | T | W | I | 9 | 7523 |
| 31 | I | S | T | P | F | C | F | L | S | V | 8 | 7524 |
| 47 | S | L | I | L | F | A | T | I | T | Q | 8 | 7525 |
| 52 | A | T | I | T | Q | P | S | L | H | E | 8 | 7526 |
| 25 | E | A | F | H | T | W | I | S | I | P | 7 | 7527 |
| 13 | S | I | I | F | L | L | T | G | V | P | 6 | 7528 |
| 11 | S | T | S | I | I | F | L | L | T | G | 5 | 7529 |
| 43 | L | L | G | N | S | L | I | L | F | A | 5 | 7530 |
| 48 | L | I | L | F | A | T | I | T | Q | P | 5 | 7531 |
| 2 | I | T | S | T | L | Q | N | I | T | S | 4 | 7532 |
| 3 | T | S | T | L | Q | N | I | T | S | T | 4 | 7533 |
| 4 | S | T | L | Q | N | I | T | S | T | S | 4 | 7534 |
| 12 | T | S | T | I | F | L | L | T | G | V | 4 | 7535 |
| 14 | I | I | F | L | L | T | G | V | P | G | 4 | 7536 |
| 16 | F | L | T | G | V | P | G | L | E | A | 4 | 7537 |
| 32 | S | I | P | F | C | F | L | S | V | T | 4 | 7538 |
| 33 | I | P | F | C | F | L | S | V | T | A | 4 | 7539 |
| 36 | C | F | L | S | V | T | A | L | L | G | 4 | 7540 |
| 59 | L | H | E | P | M | Y | Y | F | L | S | 4 | 7541 |
| 10 | T | S | T | S | I | I | F | L | L | T | | 7542 |

TABLE XIXB part 3

| Pos | 1 | 2 | 3 | 4 | 5 | 6 | 7 | 8 | 9 | 0 | score | SEQ ID |
|---|---|---|---|---|---|---|---|---|---|---|---|---|

HLA-A*0201 10-mers v.2: 238P1B2

| 8 | L | L | T | S | P | L | M | N | P | V | 22 | 7543 |
| 7 | Y | L | L | T | S | P | L | M | N | P | 18 | 7544 |
| 2 | M | I | A | N | T | Y | L | L | T | S | 17 | 7545 |
| 9 | L | T | S | P | L | M | N | P | V | I | 17 | 7546 |
| 1 | T | M | I | A | N | T | Y | L | L | T | 15 | 7547 |
| 3 | I | A | N | T | Y | L | L | T | S | P | 13 | 7548 |

TABLE XIXB-continued part 3

| Pos | 1 | 2 | 3 | 4 | 5 | 6 | 7 | 8 | 9 | 0 | score | SEQ ID |
|---|---|---|---|---|---|---|---|---|---|---|---|---|
| 4 | A | N | T | Y | L | L | T | S | P | L | 10 | 7549 |
| 5 | N | T | Y | L | L | T | S | P | L | M | 10 | 7550 |
| 6 | T | Y | L | L | T | S | P | L | M | N | 3 | 7551 |
| 10 | T | S | P | L | M | N | P | V | I | Y | 2 | 7552 |

**HLA-A*0202 10-mers v.2: 238P1B2**

| 2 | M | I | A | N | T | Y | L | L | T | S | 3 | 7553 |
| 3 | I | A | N | T | Y | L | L | T | S | P | 2 | 7554 |
| 4 | A | N | T | Y | L | L | T | S | P | L | 1 | 7555 |

HLA-A1 10-mers v.2: 238P1B2

| 10 | T | S | P | L | M | N | P | V | I | Y | 19 | 7556 |
| 9 | L | T | S | P | L | M | N | P | V | I | 12 | 7557 |
| 1 | T | M | I | A | N | T | Y | L | L | T | 8 | 7558 |
| 5 | N | T | Y | L | L | T | S | P | L | M | 8 | 7559 |
| 6 | T | Y | L | L | T | S | P | L | M | N | 7 | 7560 |
| 2 | M | I | A | N | T | Y | L | L | T | S | 6 | 7561 |
| 7 | Y | L | L | T | S | P | L | M | N | P | 3 | 7562 |
| 4 | A | N | T | Y | L | L | T | S | P | L | 1 | 7563 |
| 8 | L | L | T | S | P | L | M | N | P | V | 1 | 7564 |

HLA-A26 10-mers v.2: 238P1B2

| 5 | N | T | Y | L | L | T | S | P | L | M | 19 | 7565 |
| 2 | M | I | A | N | T | Y | L | L | T | S | 15 | 7566 |
| 7 | Y | L | L | T | S | P | L | M | N | P | 14 | 7567 |
| 8 | L | L | T | S | P | L | M | N | P | V | 13 | 7568 |
| 9 | L | T | S | P | L | M | N | P | V | I | 13 | 7569 |
| 10 | T | S | P | L | M | N | P | V | I | Y | 12 | 7570 |
| 4 | A | N | T | Y | L | L | T | S | P | L | 9 | 7571 |
| 1 | T | M | I | A | N | T | Y | L | L | T | 6 | 7572 |
| 3 | I | A | N | T | Y | L | L | T | S | P | 5 | 7573 |
| 6 | T | Y | L | L | T | S | P | L | M | N | 1 | 7574 |

HLA-A3 10-mers v.2: 238P1B2

| 2 | M | I | A | N | T | Y | L | L | T | S | 17 | 7575 |
| 7 | Y | L | L | T | S | P | L | M | N | P | 13 | 7576 |
| 10 | T | S | P | L | M | N | P | V | I | Y | 12 | 7577 |
| 8 | L | L | T | S | P | L | M | N | P | V | 10 | 7578 |
| 1 | T | M | I | A | N | T | Y | L | L | T | 8 | 7579 |
| 6 | T | Y | L | L | T | S | P | L | M | N | 8 | 7580 |
| 9 | L | T | S | P | L | M | N | P | V | I | 7 | 7581 |
| 4 | A | N | T | Y | L | L | T | S | P | L | 6 | 7582 |
| 3 | I | A | N | T | Y | L | L | T | S | P | 5 | 7583 |
| 5 | N | T | Y | L | L | T | S | P | L | M | 5 | 7584 |

**HLA-B*0702 10-mers v.2: 238P1B2**

| 4 | A | N | T | Y | L | L | T | S | P | L | 14 | 7585 |
| 9 | L | T | S | P | L | M | N | P | V | I | 11 | 7586 |
| 1 | T | M | I | A | N | T | Y | L | L | T |  | 7587 |

TABLE XIXC part 1

| Pos | 1 | 2 | 3 | 4 | 5 | 6 | 7 | 8 | 9 | 0 | 1 | 2 | 3 | 4 | 5 | score | SEQ ID |
|---|---|---|---|---|---|---|---|---|---|---|---|---|---|---|---|---|---|

**HLA-DRB1*0101 15-mers v.1: 238P1B2**

| 2 | Y | Y | F | L | S | M | L | S | A | T | D | L | G | L | S | 34 | 7588 |
| 151 | V | D | L | L | L | I | L | L | S | Y | V | L | I | I | R | 33 | 7589 |
| 46 | I | K | F | F | T | V | M | E | S | S | V | L | L | A | M | 32 | 7590 |
| 191 | A | I | Y | Y | I | P | L | I | S | L | S | I | V | H | R | 32 | 7591 |
| 203 | V | H | R | F | G | K | Q | A | P | A | Y | V | H | T | M | 32 | 7592 |
| 92 | I | R | G | L | L | M | L | T | P | M | V | A | L | L | I | 31 | 7593 |
| 95 | L | L | M | L | T | P | M | V | A | L | L | I | R | L | S | 31 | 7594 |
| 158 | L | S | Y | V | L | I | I | R | T | V | L | S | V | A | S | 31 | 7595 |

TABLE XIXC-continued part 1

| Pos | 1 | 2 | 3 | 4 | 5 | 6 | 7 | 8 | 9 | 0 | 1 | 2 | 3 | 4 | 5 | score | SEQ ID |
|---|---|---|---|---|---|---|---|---|---|---|---|---|---|---|---|---|---|
| 14 | G | L | S | I | S | T | L | V | T | M | L | S | I | F | W | 30 | 7596 |
| 161 | V | L | I | I | R | T | V | L | S | V | A | S | P | E | E | 30 | 7597 |
| 181 | S | T | C | V | S | H | I | V | A | F | A | I | Y | Y | I | 30 | 7598 |
| 230 | N | P | V | I | Y | S | V | K | T | K | Q | I | R | R | A | 29 | 7599 |
| 157 | L | L | S | Y | V | L | I | I | R | T | V | L | S | V | A | 27 | 7600 |
| 18 | S | T | L | V | T | M | L | S | I | F | W | F | N | V | R | 26 | 7601 |
| 89 | A | S | V | I | R | G | L | L | M | L | T | P | M | V | A | 26 | 7602 |
| 98 | L | T | P | M | V | A | L | L | I | R | L | S | Y | C | H | 26 | 7603 |
| 199 | S | L | S | I | V | H | R | F | G | K | Q | A | P | A | Y | 26 | 7604 |
| 33 | E | I | S | F | N | A | C | L | S | H | M | F | F | I | K | 25 | 7605 |
| 133 | D | T | R | I | N | S | A | V | G | L | T | A | M | F | S | 25 | 7606 |
| 136 | I | N | S | A | V | G | L | T | A | M | F | S | T | V | G | 25 | 7607 |
| 143 | T | A | M | F | S | T | V | G | V | D | L | L | I | L | L | 25 | 7608 |
| 148 | T | V | G | V | D | L | L | L | I | L | L | S | Y | V | L | 25 | 7609 |
| 152 | D | L | L | L | I | L | L | S | Y | V | L | I | I | R | T | 25 | 7610 |
| 10 | A | T | D | L | G | L | S | I | S | T | L | V | T | M | L | 24 | 7611 |
| 25 | S | I | F | W | F | N | V | R | E | I | S | F | N | A | C | 24 | 7612 |
| 45 | F | I | K | F | F | T | V | M | E | S | S | V | L | L | A | 24 | 7613 |
| 51 | V | M | E | S | S | V | L | L | A | M | A | F | D | R | F | 24 | 7614 |
| 73 | R | Y | A | M | I | L | T | D | S | R | I | A | Q | I | G | 24 | 7615 |
| 102 | V | A | L | L | I | R | L | S | Y | C | H | S | Q | V | L | 24 | 7616 |
| 142 | L | T | A | M | F | S | T | V | Q | V | D | L | L | L | I | 24 | 7617 |
| 177 | K | E | T | F | S | T | C | V | S | H | I | V | A | F | A | 24 | 7618 |
| 222 | Y | L | L | I | S | P | L | M | N | P | V | I | Y | S | V | 24 | 7619 |
| 37 | N | A | C | L | S | H | M | F | F | I | K | F | F | T | V | 23 | 7620 |
| 40 | L | S | H | M | F | F | I | K | F | F | T | V | M | E | S | 23 | 7621 |
| 71 | P | L | R | Y | A | M | I | L | T | D | S | R | I | A | Q | 23 | 7622 |
| 80 | D | S | R | I | A | Q | I | G | V | A | S | V | I | R | G | 23 | 7623 |
| 131 | C | T | D | T | R | I | N | S | A | V | G | L | T | A | M | 23 | 7624 |
| 150 | G | V | D | L | L | L | I | L | L | S | Y | V | L | I | I | 23 | 7625 |
| 192 | I | Y | Y | I | P | L | I | S | L | S | I | V | H | R | F | 23 | 7626 |
| 218 | I | A | N | T | Y | L | L | I | S | P | L | M | N | P | V | 23 | 7627 |
| 219 | A | N | T | Y | L | L | I | S | P | L | M | N | P | V | I | 23 | 7628 |
| 1 | M | Y | Y | F | L | S | M | L | S | A | T | D | L | G | L | 22 | 7629 |
| 20 | L | V | T | M | L | S | I | F | W | F | N | V | R | E | I | 22 | 7630 |
| 41 | S | H | M | F | F | I | K | F | F | T | V | M | E | S | S | 22 | 7631 |
| 54 | S | S | V | L | L | A | M | A | F | D | R | F | V | A | V | 22 | 7632 |
| 79 | T | D | S | R | I | A | Q | I | Q | V | A | S | V | I | R | 22 | 7633 |
| 85 | Q | I | G | V | A | S | V | I | R | G | L | L | M | L | T | 22 | 7634 |
| 86 | I | G | V | A | S | V | I | R | G | L | L | M | L | T | P | 22 | 7635 |
| 105 | L | I | R | L | S | Y | C | H | S | Q | V | L | H | H | S | 22 | 7636 |
| 139 | A | V | G | L | T | A | M | F | S | T | V | G | V | D | L | 22 | 7637 |
| 189 | A | F | A | I | Y | Y | I | P | L | I | S | L | S | I | V | 22 | 7638 |
| 211 | P | A | Y | V | H | T | M | I | A | N | T | Y | L | L | I | 22 | 7639 |
| 17 | I | S | T | L | V | T | M | L | S | I | F | W | F | N | V | 21 | 7640 |
| 91 | V | I | R | G | L | L | M | L | T | P | M | V | A | L | L | 21 | 7641 |
| 187 | I | V | A | F | A | I | Y | Y | I | P | L | I | S | L | S | 21 | 7642 |
| 190 | F | A | I | Y | Y | I | P | L | I | S | L | S | I | V | H | 21 | 7643 |
| 164 | I | R | T | V | L | S | V | A | S | P | E | E | R | K | E | 20 | 7644 |
| 208 | K | Q | A | P | A | Y | V | H | T | M | I | A | N | T | Y | 20 | 7645 |
| 12 | D | L | G | L | S | I | S | T | L | V | T | M | L | S | I | 19 | 7646 |
| 24 | L | S | I | F | W | F | N | V | R | E | I | S | F | N | A | 19 | 7647 |
| 72 | L | R | Y | A | M | I | L | T | D | S | R | I | A | Q | I | 19 | 7648 |
| 81 | S | R | I | A | Q | I | G | V | A | S | V | I | R | G | L | 19 | 7649 |
| 119 | S | Y | C | Y | H | P | D | V | M | K | L | S | C | T | D | 19 | 7650 |
| 123 | H | P | D | V | M | K | L | S | C | T | D | T | R | I | N | 19 | 7651 |
| 159 | S | Y | V | L | I | I | R | T | V | L | S | V | A | S | P | 19 | 7652 |
| 197 | L | I | S | L | S | I | V | H | R | F | G | K | Q | A | P | 19 | 7653 |
| 220 | N | T | Y | L | L | I | S | P | L | M | N | P | V | I | Y | 19 | 7654 |
| 238 | T | K | Q | I | R | R | A | V | I | K | I | L | H | S | K | 19 | 7655 |
| 4 | F | L | S | M | L | S | A | T | D | L | G | L | S | I | S | 18 | 7656 |
| 7 | M | L | S | A | T | D | L | G | L | S | I | S | T | L | V | 18 | 7657 |
| 42 | H | M | F | F | I | K | F | F | T | V | M | E | S | S | V | 18 | 7658 |
| 43 | M | F | F | I | K | F | F | T | V | M | E | S | S | V | L | 18 | 7659 |
| 55 | S | V | L | L | A | M | A | F | D | R | F | V | A | V | S | 18 | 7660 |
| 59 | A | M | A | F | D | R | F | V | A | V | S | N | P | L | R | 18 | 7661 |
| 90 | S | V | I | R | G | L | L | M | L | T | P | M | V | A | L | 18 | 7662 |
| 233 | I | Y | S | V | K | T | K | Q | I | R | R | A | V | I | K | 18 | 7663 |
| 234 | Y | S | V | K | T | K | Q | I | R | R | A | V | I | R | I | 18 | 7664 |
| 23 | M | L | S | I | F | W | F | N | V | R | E | I | S | F | N | 17 | 7665 |
| 53 | E | S | S | V | L | L | A | M | A | F | D | R | F | V | A | 17 | 7666 |
| 57 | L | L | A | M | A | F | D | R | F | V | A | V | S | N | P | 17 | 7667 |
| 60 | M | A | F | D | R | F | V | A | V | S | N | P | L | R | Y | 17 | 7668 |
| 62 | F | D | R | F | V | A | V | S | N | P | L | R | Y | A | M | 17 | 7669 |
| 66 | V | A | V | S | N | P | L | R | Y | A | M | I | L | T | D | 17 | 7670 |

TABLE XIXC-continued part 1

| Pos | 1 2 3 | 4 5 6 | 7 8 9 | 0 1 2 | 3 4 5 | score | SEQ ID |
|---|---|---|---|---|---|---|---|
| 67 | A V S | N P L | R Y A | M I L | T D S | 17 | 7671 |
| 75 | A M I | L T D | S R I | A Q I | G V A | 17 | 7672 |
| 93 | R G L | L M L | T P M | V A L | L I R | 17 | 7673 |
| 99 | T P M | V A L | L I R | L S Y | C H S | 17 | 7674 |
| 101 | M V A | L L I | R L S | Y C H | S Q V | 17 | 7675 |
| 140 | V G L | T A M | F S T | V G V | D L L | 17 | 7676 |
| 147 | S T V | G V D | L L L | I L L | S Y V | 17 | 7677 |
| 153 | L L L | I L L | S Y V | L I I | R T V | 17 | 7678 |
| 156 | I L L | S Y V | L I I | R T V | L S V | 17 | 7679 |
| 162 | L I I | R T V | L S V | A S P | E E R | 17 | 7680 |
| 184 | V S H | I V A | F A I | Y Y I | P L I | 17 | 7681 |
| 185 | S H I | V A F | A I Y | Y I P | L I S | 17 | 7682 |
| 195 | I P L | I S L | S I V | H R F | G K Q | 17 | 7683 |
| 200 | L S I | V H R | F G K | Q A P | A Y V | 17 | 7684 |
| 212 | A Y V | H T M | I A N | T Y L | L I S | 17 | 7685 |
| 213 | Y V H | T M I | A N T | Y L L | I S P | 17 | 7686 |
| 217 | M I A | N T Y | L L I | S P L | M N P | 17 | 7687 |
| 5 | L S M | L S A | T D L | G L S | I S T | 16 | 7688 |
| 6 | S M L | S A T | D L G | L S I | S T L | 16 | 7689 |
| 9 | S A T | D L Q | L S I | S T L | V T M | 16 | 7690 |
| 15 | L S I | S T L | V T M | L S I | F W F | 16 | 7691 |
| 28 | W F N | V R E | I S F | N A C | L S H | 16 | 7692 |
| 30 | N V R | E I S | F N A | C L S | H M F | 16 | 7693 |
| 34 | I S F | N A C | L S H | M F F | I K F | 16 | 7694 |
| 47 | K F F | T V M | E S S | V L L | A M A | 16 | 7695 |
| 48 | F F T | V M E | S S V | L L A | M A F | 16 | 7696 |
| 49 | F T V | M E S | S V L | L A M | A F D | 16 | 7697 |
| 65 | F V A | V S N | P L R | Y A M | I L T | 16 | 7698 |
| 77 | I L T | D S R | T A Q | I G V | A S V | 16 | 7699 |
| 94 | G L L | M L T | P M V | A L L | I R L | 16 | 7700 |
| 113 | S Q V | L H H | S Y C | Y H P | D V M | 16 | 7701 |
| 124 | P D V | M K L | S C T | D T R | I N S | 16 | 7702 |
| 134 | T R I | N S A | V G L | T A M | F S T | 16 | 7703 |
| 146 | F S T | V G V | D L L | L I L | L S Y | 16 | 7704 |
| 160 | Y V L | I I R | T V L | S V A | S P E | 16 | 7705 |
| 173 | P E E | R K E | T F S | T C V | S H I | 16 | 7706 |
| 194 | Y I P | L I S | L S I | V H R | F G K | 16 | 7707 |
| 214 | V H T | M I A | N T Y | L L I | S E L | 16 | 7708 |
| 215 | H T M | I A N | T Y L | L I S | P L M | 16 | 7709 |
| 221 | T Y L | L I S | P L M | N P V | I Y S | 16 | 7710 |
| 225 | I S P | L M N | P V I | Y S V | K T K | 16 | 7711 |
| 27 | F W F | N V R | E I S | F N A | C L S | 15 | 7712 |
| 70 | N P L | R Y A | M I L | T D S | R I A | 15 | 7713 |
| 126 | V M K | L S C | T D T | R I N | S A V | 15 | 7714 |
| 145 | M F S | T V G | V D L | L L I | L L S | 15 | 7715 |
| 178 | E T F | S T C | V S H | I V A | F A I | 15 | 7716 |
| 226 | S P L | M N P | V I Y | S V K | T K Q | 15 | 7717 |
| 235 | S V K | T K Q | I R R | A V I | K I L | 15 | 7718 |
| 50 | T V M | E S S | V L L | A M A | F D R | 14 | 7719 |
| 61 | A F D | R F V | A V S | N P L | R Y A | 14 | 7720 |
| 63 | D R F | V A V | S N P | L R Y | A M I | 14 | 7721 |
| 108 | L S Y | C H S | Q V L | H H S | Y C Y | 14 | 7722 |
| 116 | L H H | S Y C | Y H P | D V M | K L S | 14 | 7723 |
| 135 | R I N | S A V | G L T | A M F | S T V | 14 | 7724 |
| 155 | L I L | L S Y | V L I | I R T | V L S | 14 | 7725 |
| 165 | R T V | L S V | A S P | E E R | K E T | 14 | 7726 |
| 174 | E E R | K E T | F S T | C V S | H I V | 14 | 7727 |
| 186 | H I V | A F A | I Y Y | I P L | I S L | 14 | 7728 |
| 188 | V A F | A I Y | Y I P | L I S | L S I | 14 | 7729 |
| 240 | Q I R | R A V | I K I | L H S | K E T | 14 | 7730 |
| 78 | L T D | S R I | A Q I | G V A | S V I | 13 | 7731 |
| 87 | G V A | S V I | R G L | L M L | T P M | 13 | 7732 |
| 130 | S C T | D T R | I N S | A V G | L T A | 13 | 7733 |
| 223 | L L I | S P L | M N P | V I Y | S V K | 13 | 7734 |
| 227 | P L M | N P V | I Y S | V K T | K Q I | 13 | 7735 |
| 11 | T D L | G L S | I S T | L V T | M L S | 12 | 7736 |
| 26 | I F W | F N V | R E I | S F N | A C L | 12 | 7737 |
| 82 | R I A | Q I G | V A S | V I R | G L L | 12 | 7738 |
| 84 | A Q I | G V A | S V I | R G L | L M L | 12 | 7739 |
| 21 | V T M | L S I | F W F | N V R | E I S | 11 | 7740 |
| 29 | F N V | R E I | S F N | A C L | S H M | 11 | 7741 |
| 103 | A L L | I R L | S Y C | H S Q | V L H | 11 | 7742 |
| 167 | V L S | V A S | P E E | R K E | T F S | 11 | 7743 |
| 201 | S I V | H R F | G K Q | A P A | Y V H | 11 | 7744 |
| 210 | A P A | Y V H | T M I | A N T | Y L L | 11 | 7745 |
| 236 | V K T | K Q I | R R A | V I K | I L H | 11 | 7746 |
| 38 | A C L | S H M | F F I | K F F | T V M | 10 | 7747 |
| 52 | M E S | S V L | L A M | A F D | R F V | 10 | 7748 |
| 64 | R F V | A V S | N P L | R Y A | M I L | 10 | 7749 |
| 69 | S N P | L R Y | A M I | L T D | S R I | 10 | 7750 |
| 107 | R L S | Y C H | S Q V | L H H | S Y C | 10 | 7751 |
| 117 | H H S | Y C Y | H P D | V M K | L S C | 10 | 7752 |
| 163 | I I R | T V L | S V A | S P E | E R K | 10 | 7753 |
| 229 | M N P | V I Y | S V K | T K Q | I R R | 10 | 7754 |
| 231 | P V I | Y S V | K T K | Q I R | R A V | 10 | 7755 |
| 13 | L G L | S I S | T L V | T M L | S I F | 9 | 7756 |
| 31 | V R E | I S F | N A C | L S H | M F F | 9 | 7757 |
| 35 | S F N | A C L | S H M | F F I | K F F | 9 | 7758 |
| 44 | F F I | K F F | T V M | E S S | V L L | 9 | 7759 |
| 118 | H S Y | C Y H | P D V | M K L | S C T | 9 | 7760 |
| 125 | D V M | K L S | C T D | T R I | N S A | 9 | 7761 |
| 128 | K L S | C T D | T R I | N S A | V G L | 9 | 7762 |
| 137 | N S A | V G L | T A M | F S T | V G V | 9 | 7763 |
| 144 | A M F | S T V | G V D | L L L | I L L | 9 | 7764 |
| 149 | V G V | D L L | L I L | L S Y | V L I | 9 | 7765 |
| 170 | V A S | P E E | R K E | T F S | T C V | 9 | 7766 |
| 180 | F S T | C V S | H I V | A F A | I Y Y | 9 | 7767 |
| 182 | T C V | S H I | V A F | A I Y | Y I P | 9 | 7768 |
| 193 | Y Y I | P L I | S L S | I V H | R F G | 9 | 7769 |
| 204 | R F G | K Q A | P A Y | V H T | M T I | 9 | 7770 |
| 207 | G K Q | A P A | Y V H | T M I | A N T | 9 | 7771 |
| 216 | T M I | A N T | Y L L | I S P | L M N | 9 | 7772 |
| 224 | L I S | P L M | N P V | I Y S | V K T | 9 | 7773 |
| 237 | K T K | Q I R | R A V | I K I | L H S | 9 | 7774 |
| 16 | S I S | T L V | T M L | S I F | W F N | 8 | 7775 |
| 32 | R E I | S F N | A C L | S H M | F F I | 8 | 7776 |
| 56 | V L L | A M A | F D R | F V A | V S N | 8 | 7777 |
| 58 | L A M | A F D | R F V | A V S | N P L | 8 | 7778 |
| 74 | Y A M | I L T | D S R | I A Q | I G V | 8 | 7779 |
| 76 | M I L | T D S | R I A | Q I G | V A S | 8 | 7780 |
| 83 | I A Q | I G V | A S V | I R G | L L M | 8 | 7781 |
| 88 | V A S | V I R | G L L | M L T | P M V | 8 | 7782 |
| 97 | M L T | P M V | A L L | I R L | S Y C | 8 | 7783 |
| 104 | L L I | R L S | Y C H | S Q V | L H H | 8 | 7784 |
| 110 | Y C H | S Q V | L H H | S Y C | Y H P | 8 | 7785 |
| 111 | C H S | Q V L | H H S | Y C Y | H P D | 8 | 7786 |
| 112 | H S Q | V L H | H S Y | C Y H | P D V | 8 | 7787 |
| 115 | V L H | H S Y | C Y H | P D V | M K L | 8 | 7788 |
| 122 | Y H P | D V M | K L S | C T D | T R I | 8 | 7789 |
| 127 | M K L | S C T | D T R | I N S | A V G | 8 | 7790 |
| 129 | L S C | T D T | R I N | S A V | G L T | 8 | 7791 |
| 138 | S A V | G L T | A M F | S T V | G V D | 8 | 7792 |
| 154 | L L I | L L S | Y V L | I I R | T V L | 8 | 7793 |
| 169 | S V A | S P E | E R K | E T F | S T C | 8 | 7794 |
| 176 | R K E | T F S | T C V | S H I | V A F | 8 | 7795 |
| 179 | T F S | T C V | S H I | V A F | A I Y | 8 | 7796 |
| 183 | C V S | H I V | A F A | I Y Y | I P L | 8 | 7797 |
| 202 | I V H | R F G | K Q A | P A Y | V H T | 8 | 7798 |
| 206 | F G K | Q A P | A Y V | H T M | I A N | 8 | 7799 |
| 239 | K Q I | R R A | V I K | I L H | S K E | 8 | 7800 |
| 3 | Y F L | S M L | S A T | D L G | L S I | 7 | 7801 |
| 8 | L S A | T D L | G L S | I S T | L V T | 7 | 7802 |
| 96 | L M L | T P M | V A L | L I R | S Y C | 7 | 7803 |
| 100 | P M V | A L L | I R L | S Y C | H S Q | 7 | 7804 |
| 171 | A S P | E E R | K E T | F S T | C V S | 7 | 7805 |
| 196 | P L I | S L S | I V H | R F G | K Q A | 7 | 7806 |
| 109 | S Y C | H S Q | V L H | H S Y | C Y H | 6 | 7807 |
| 120 | Y C Y | H P D | V M K | L S C | T D T | 6 | 7808 |
| 121 | C Y H | P D V | M K L | S C T | D T R | 6 | 7809 |
| 228 | L M N | P V I | Y S V | K T K | Q I R | 5 | 7810 |
| 172 | S P E | E R K | E T F | S T C | V S H | 4 | 7811 |
| 232 | V I Y | S V K | T K Q | I R R | A V I | 3 | 7812 |
| 168 | L S V | A S P | E E R | K E T | F S T | 2 | 7813 |
| 175 | E R K | E T F | S T C | V S H | I V A | 2 | 7814 |
| 19 | T L V | T M L | S I F | W F N | V R E | 1 | 7815 |
| 22 | T M L | S I F | W F N | V R E | I S F | 1 | 7816 |
| 39 | C L S | H M F | F I K | F F T | V M E | 1 | 7817 |
| 141 | G L T | A M F | S T V | G V D | L L L | 1 | 7818 |
| 166 | T V L | S V A | S P E | E R K | E T F | 1 | 7819 |
| 198 | I S L | S I V | H R F | G K Q | A P A | 1 | 7820 |

TABLE XIXC-continued part 1

HLA-DRB1*0301 (DR17) 15-mers v.1: 238P1B2

| Pos | 1 2 3 | 4 5 6 | 7 8 9 | 0 1 2 | 3 4 5 | score | SEQ ID |
|---|---|---|---|---|---|---|---|
| 74 | Y A M | I L T | D S R | I A Q | I G V | 30 | 7821 |
| 146 | F S T | V G V | D L L | L I L | L S Y | 30 | 7822 |
| 85 | Q I G | V A S | V I R | G L L | M L T | 26 | 7823 |
| 99 | T P M | V A L | L I R | L S Y | C H S | 26 | 7824 |
| 4 | F L S | M L S | A T D | L G L | S I S | 22 | 7825 |
| 57 | L L A | M A F | D R F | V A V | S N F | 22 | 7826 |
| 93 | R G L | L M L | T P M | V A L | L I R | 22 | 7827 |
| 94 | G L L | M L T | P M V | A L L | I R L | 22 | 7828 |
| 18 | S T L | V T M | L S I | F W F | N V R | 21 | 7829 |
| 151 | V D L | L L I | L L S | Y V L | I I R | 21 | 7830 |
| 2 | Y Y F | L S M | L S A | T D L | G L S | 20 | 7831 |
| 54 | S S V | L L A | M A F | D R F | V A V | 20 | 7832 |
| 142 | L T A | M F S | T V G | V D L | L L I | 20 | 7833 |
| 37 | N A C | L S H | M F F | I K F | F T V | 19 | 7834 |
| 63 | D R F | V A V | S N P | L R Y | A M I | 19 | 7835 |
| 105 | L I R | L S Y | C H S | Q V L | H H S | 19 | 7836 |
| 167 | V L S | V A S | P E E | R K E | T F S | 19 | 7837 |
| 189 | A F A | I Y Y | I P L | I S L | S I V | 19 | 7838 |
| 195 | I P L | I S L | S I V | H R F | G K Q | 19 | 7839 |
| 200 | L S I | V H R | F G K | Q A P | A Y V | 19 | 7840 |
| 211 | P A Y | V H T | M I A | N T Y | L L I | 19 | 7841 |
| 238 | T K Q | I R R | A V I | K I L | H S K | 19 | 7842 |
| 46 | I K F | F T V | M E S | S V L | L A M | 18 | 7843 |
| 65 | F V A | V S N | P L R | Y A M | I L T | 18 | 7844 |
| 143 | T A M | F S T | V G V | D L L | L I L | 18 | 7845 |
| 229 | M N P | V I Y | S V K | T K Q | I R R | 18 | 7846 |
| 33 | E I S | F N A | C L S | H M F | F I K | 17 | 7847 |
| 62 | F D R | F V A | V S N | P L R | Y A M | 17 | 7848 |
| 127 | M K L | S C T | D T R | I N S | A V G | 17 | 7849 |
| 222 | Y L L | I S P | L M N | P V I | Y S V | 17 | 7850 |
| 157 | L L S | Y V L | I I R | T V L | S V A | 16 | 7851 |
| 197 | L I S | L S I | V H R | F G K | Q A P | 16 | 7852 |
| 212 | A Y V | H T M | I A N | T Y L | L I S | 16 | 7853 |
| 28 | W F N | V R E | I S F | N A C | L S H | 15 | 7854 |
| 29 | F N V | R E I | S F N | A C L | S H M | 15 | 7855 |
| 152 | D L L | L I L | L S Y | V L I | I R T | 15 | 7856 |
| 169 | S V A | S P E | E R K | E T F | S T C | 15 | 7857 |
| 20 | L V T | M L S | I F W | F N V | R E I | 14 | 7858 |
| 24 | L S I | F W F | N V R | E I S | F N A | 14 | 7859 |
| 25 | S I F | W F N | V R E | I S F | N A C | 14 | 7860 |
| 45 | F I K | F F T | V M E | S S V | L L A | 14 | 7861 |
| 48 | F F T | V M E | S S V | L L A | M A F | 14 | 7862 |
| 95 | L L M | L T P | M V A | L L I | R L S | 14 | 7863 |
| 148 | T V G | V D L | L L I | L L S | Y V L | 14 | 7864 |
| 150 | G V D | L L L | I L L | S Y V | L I I | 14 | 7865 |
| 153 | L L L | I L L | S Y V | L I I | R T V | 14 | 7866 |
| 158 | L S Y | V L I | I R T | V L S | V A S | 14 | 7867 |
| 161 | V L I | I R T | V L S | V A S | P E E | 14 | 7868 |
| 194 | Y I P | L I S | L S I | V H R | F G K | 14 | 7869 |
| 220 | N T Y | L L I | S P L | M N P | V I Y | 14 | 7870 |
| 221 | T Y L | L I S | P L M | N P V | I Y S | 14 | 7871 |
| 1 | M Y Y | F L S | M L S | A T D | L G L | 13 | 7872 |
| 47 | K F F | T V M | E S S | V L L | A M A | 13 | 7873 |
| 49 | F T V | M E S | S V L | L A M | A F D | 13 | 7874 |
| 53 | E S S | V L L | A M A | F D R | F V A | 13 | 7875 |
| 88 | V A S | V I R | G L L | M L T | P M V | 13 | 7876 |
| 89 | A S V | I R Q | L L M | L T P | M V A | 13 | 7877 |
| 92 | I R G | L L M | L T P | M V A | L L I | 13 | 7878 |
| 98 | L T P | M V A | L L I | R L S | Y C H | 13 | 7879 |
| 101 | M V A | L L I | R L S | Y C H | S Q V | 13 | 7880 |
| 112 | H S Q | V L H | H S Y | C Y H | P D V | 13 | 7881 |
| 154 | L L I | L L S | Y V L | I I R | T V L | 13 | 7882 |
| 164 | I R T | V L S | V A S | P E E | R K E | 13 | 7883 |
| 214 | V H T | M I A | N T Y | L L I | S P L | 13 | 7884 |
| 6 | S M L | S A T | D L G | L S I | S T L | 12 | 7885 |
| 10 | A T D | L G L | S I S | T L V | T M L | 12 | 7886 |
| 17 | I S T | L V T | M L S | I F W | F N V | 12 | 7887 |
| 69 | S N P | L R Y | A M I | L T D | S R I | 12 | 7888 |
| 73 | R Y A | M I L | T D S | R I A | Q I G | 12 | 7889 |
| 75 | A M I | L T D | S R I | A Q I | G V A | 12 | 7890 |
| 80 | D S R | I A Q | I G V | A S V | I R G | 12 | 7891 |
| 102 | V A L | L I R | L S Y | C H S | Q V L | 12 | 7892 |
| 103 | A L L | I R L | S Y C | H S Q | V L H | 12 | 7893 |
| 119 | S Y C | Y H P | D V M | K L S | C T D | 12 | 7894 |
| 124 | P D V | M K L | S C T | D T R | I N S | 12 | 7895 |
| 133 | D T R | I N S | A V G | L T A | M F S | 12 | 7896 |
| 149 | V G V | D L L | L I L | L S Y | V L I | 12 | 7897 |
| 159 | S Y V | L I I | R T V | L S V | A S P | 12 | 7898 |
| 192 | I Y Y | I P L | I S L | S I V | H R F | 12 | 7899 |
| 230 | N P V | I Y S | V K T | K Q I | R R A | 12 | 7900 |
| 5 | L S M | L S A | T D L | G L S | I S T | 11 | 7901 |
| 9 | S A T | D L G | L S I | S T L | V T M | 11 | 7902 |
| 12 | D L G | L S I | S T L | V T M | L S I | 11 | 7903 |
| 13 | L G L | S I S | T L V | T M L | S I F | 11 | 7904 |
| 14 | G L S | I S T | L V T | M L S | I F W | 11 | 7905 |
| 21 | V T M | L S I | F W F | N V R | E I S | 11 | 7906 |
| 31 | V R E | I S F | N A C | L S H | M F F | 11 | 7907 |
| 40 | L S H | M F F | I K F | F T V | M E S | 11 | 7908 |
| 43 | M F F | I K F | F T V | M E S | S V L | 11 | 7909 |
| 55 | S V L | L A M | A F D | R F V | A V S | 11 | 7910 |
| 83 | I A Q | I G V | A S V | I R G | L L M | 11 | 7911 |
| 87 | G V A | S V I | R G L | L M L | T P M | 11 | 7912 |
| 123 | H P D | V M K | L S C | T D T | R I N | 11 | 7913 |
| 131 | C T D | T R I | N S A | V G L | T A M | 11 | 7914 |
| 137 | N S A | V G L | T A M | F S T | V G V | 11 | 7915 |
| 139 | A V G | L T A | M F S | T V G | V D L | 11 | 7916 |
| 144 | A M F | S T V | G V D | L L L | I L L | 11 | 7917 |
| 147 | S T V | G V D | L L L | I L L | S Y V | 11 | 7918 |
| 155 | L I L | L S Y | V L I | I R T | V L S | 11 | 7919 |
| 160 | Y V L | I I R | T V L | S V A | S P E | 11 | 7920 |
| 165 | R T V | L S V | A S P | E E R | K E T | 11 | 7921 |
| 181 | S T C | V S H | I V A | F A I | Y Y I | 11 | 7922 |
| 184 | V S H | I V A | F A I | Y Y I | P L I | 11 | 7923 |
| 199 | S L S | I V H | R F G | K Q A | P A Y | 11 | 7924 |
| 215 | H T M | I A N | T Y L | L I S | P L M | 11 | 7925 |
| 226 | S P L | M N P | V I Y | S V K | T K Q | 11 | 7926 |
| 233 | I Y S | V K T | K Q I | R R A | V I K | 11 | 7927 |
| 16 | S I S | T L V | T M L | S I F | W F N | 10 | 7928 |
| 23 | M L S | I F W | F N V | R E I | S F N | 10 | 7929 |
| 42 | H M F | F I K | F F T | V M E | S S V | 10 | 7930 |
| 51 | V M E | S S V | L L A | M A F | D R F | 10 | 7931 |
| 111 | C H S | Q V L | H H S | Y C Y | H P D | 10 | 7932 |
| 113 | S Q V | L H H | S Y C | Y H P | D V M | 10 | 7933 |
| 126 | V M K | L S C | T D T | R I N | S A V | 10 | 7934 |
| 135 | R I N | S A V | G L T | A M F | S T V | 10 | 7935 |
| 179 | T F S | T C V | S H I | V A F | A I Y | 10 | 7936 |
| 185 | S H I | V A F | A I Y | Y I P | L I S | 10 | 7937 |
| 217 | M I A | N T Y | L L I | S P L | M N P | 10 | 7938 |
| 223 | L L I | S P L | M N P | V I Y | S V K | 10 | 7939 |
| 225 | I S P | L M N | P V I | Y S V | K T K | 10 | 7940 |
| 26 | I F W | F N V | R E I | S F N | A C L | 9 | 7941 |
| 34 | I S F | N A C | L S H | M F F | I K F | 9 | 7942 |
| 38 | A C L | S H M | F F I | K F F | T V M | 9 | 7943 |
| 59 | A M A | F D R | F V A | V S N | P L R | 9 | 7944 |
| 61 | A F D | R F V | A V S | N P L | R Y A | 9 | 7945 |
| 67 | A V S | N P L | R Y A | M I L | T D S | 9 | 7946 |
| 84 | A Q I | G V A | S V I | R G L | L M L | 9 | 7947 |
| 97 | M L T | P M V | A L L | I R L | S Y G | 9 | 7948 |
| 106 | I R L | S Y C | H S Q | V L H | H S Y | 9 | 7949 |
| 109 | S Y C | H S Q | V L H | H S Y | C Y H | 9 | 7950 |
| 118 | H S Y | C Y H | P D V | M K L | S C T | 9 | 7951 |
| 182 | T C V | S H I | V A F | A I Y | Y I P | 9 | 7952 |
| 183 | C V S | H I V | A F A | I Y Y | I P L | 9 | 7953 |
| 187 | I V A | F A I | Y Y I | P L I | S L S | 9 | 7954 |
| 201 | S I V | H R F | G K Q | A P A | Y V H | 9 | 7955 |
| 202 | I V H | R F G | K Q A | P A Y | V H T | 9 | 7956 |
| 203 | V H R | F C K | Q A P | A Y V | H T M | 9 | 7957 |
| 213 | Y V H | T M I | A N T | Y L L | I S P | 9 | 7958 |
| 22 | T M L | S I F | W F N | V R E | I S F | 8 | 7959 |
| 41 | S H M | F F I | K F F | T V M | E S S | 8 | 7960 |
| 166 | T V L | S V A | S P E | E R K | E T F | 8 | 7961 |
| 168 | L S V | A S P | E E R | K E T | F S T | 8 | 7962 |
| 170 | V A S | P E E | R K E | T F S | T C V | 8 | 7963 |
| 177 | K E T | F S T | C V S | H I V | A F A | 8 | 7964 |
| 186 | H I V | A F A | I Y Y | I P L | I S L | 8 | 7965 |
| 232 | V I Y | S V K | T K Q | I R R | A V I | 8 | 7966 |
| 234 | Y S V | K T K | Q I R | R A V | I K I | 8 | 7967 |

TABLE XIXC-continued part 1

| Pos | 1 2 3 | 4 5 6 | 7 8 9 | 0 1 2 | 3 4 5 | score | SEQ ID |
|---|---|---|---|---|---|---|---|
| 235 | S V K | T K Q | I R R | A V I | K I L | 8 | 7968 |
| 239 | K Q I | R R A | V T K | I L H | S K E | 8 | 7969 |
| 120 | Y C Y | H P D | V M K | L S C | T D T | 7 | 7970 |
| 129 | L S C | T D T | R I N | S A V | G L T | 7 | 7971 |
| 231 | P V I | Y S V | K T K | Q I R | R A V | 7 | 7972 |
| 39 | C L S | H M F | F I K | F F T | V M E | 6 | 7973 |
| 56 | V L L | A M A | F D R | F V A | V S N | 6 | 7974 |
| 77 | I L T | D S R | I A Q | I G V | A S V | 6 | 7975 |
| 11 | T D L | G L S | I S T | L V T | M L S | 5 | 7976 |
| 219 | A N T | Y L L | I S P | L M N | P V I | 5 | 7977 |
| 91 | V I R | G L L | M L T | P M V | A L L | 4 | 7978 |
| 224 | L I S | P L M | N P V | I Y S | V K T | 4 | 7979 |
| 15 | L S I | S T L | V T M | L S I | F W F | 3 | 7980 |
| 30 | N V R | E I S | F N A | C L S | H M F | 3 | 7981 |
| 36 | F N A | C L S | H M F | F I K | F F T | 3 | 7982 |
| 50 | T V M | E S S | V L L | A M A | F D R | 3 | 7983 |
| 52 | M E S | S V L | L A M | A F D | R F V | 3 | 7984 |
| 64 | R F V | A V S | N P L | R Y A | M I L | 3 | 7985 |
| 68 | V S N | P L R | Y A M | I L T | D S R | 3 | 7986 |
| 79 | T D S | R I A | Q I G | V A S | V I R | 3 | 7987 |
| 100 | P M V | A L L | I R L | S Y C | H S Q | 3 | 7988 |
| 104 | L L I | R L S | Y C H | S Q V | L H H | 3 | 7989 |
| 122 | Y H P | D V M | K L S | C T D | T R I | 3 | 7990 |
| 125 | D V M | K L S | C T D | T R I | N S A | 3 | 7991 |
| 140 | V G L | T A M | F S T | V G V | D L L | 3 | 7992 |
| 145 | M F S | T V G | V D L | L L I | L L S | 3 | 7993 |
| 162 | L I I | R T V | L S V | A S P | E E R | 3 | 7994 |
| 180 | F S T | C V S | H I V | A F A | I Y Y | 3 | 7995 |
| 191 | A I Y | Y I P | L I S | L S I | V H R | 3 | 7996 |
| 193 | Y Y I | P L I | S L S | I V H | R F G | 3 | 7997 |
| 196 | P L I | S L S | I V H | R F G | K Q A | 3 | 7998 |
| 210 | A P A | Y V H | T M I | A N T | Y L L | 3 | 7999 |
| 3 | Y F L | S M L | S A T | D L G | L S I | 2 | 8000 |
| 7 | M L S | A T D | L G L | S I S | T L V | 2 | 8001 |
| 8 | L S A | T D L | G L S | I S T | L V T | 2 | 8002 |
| 27 | F W F | N V R | E I S | F N A | C L S | 2 | 8003 |
| 60 | M A F | D R F | V A V | S N P | L R Y | 2 | 8004 |
| 66 | V A V | S N P | L R Y | A M I | L T D | 2 | 8005 |
| 71 | P L R | Y A M | I L T | D S R | I A Q | 2 | 8006 |
| 76 | M I L | T D S | R I A | Q I G | V A S | 2 | 8007 |
| 82 | R I A | Q I G | V A S | V I R | G L L | 2 | 8008 |
| 86 | I G V | A S V | I R G | L L M | L T P | 2 | 8009 |
| 96 | M L T | P M V | A L L | I R L | S Y | 2 | 8010 |
| 117 | H H S | Y C Y | H P D | V M K | L S C | 2 | 8011 |
| 128 | K L S | C T D | T R I | N S A | V G L | 2 | 8012 |
| 130 | S C T | D T R | I N S | A V G | L T A | 2 | 8013 |
| 132 | T D T | R I N | S A V | G L T | A M F | 2 | 8014 |
| 134 | T R I | N S A | V G L | T A M | F S T | 2 | 8015 |
| 138 | S A V | G L T | A M F | S T V | G V D | 2 | 8016 |
| 163 | I I R | T V L | S V A | S P E | E R K | 2 | 8017 |
| 173 | P E E | R K E | T F S | T C V | S H I | 2 | 8018 |
| 175 | E R K | E T F | S T C | V S H | I V A | 2 | 8019 |
| 178 | E T F | S T C | V S H | I V A | F A I | 2 | 8020 |
| 188 | V A F | A I Y | Y I P | L I S | L S I | 2 | 8021 |
| 190 | F A I | Y Y I | P L I | S L S | I V H | 2 | 8022 |
| 198 | I S L | S I V | H R F | G K Q | A P A | 2 | 8023 |
| 204 | H R F | G K Q | A P A | Y V H | T M I | 2 | 8024 |
| 218 | I A N | T Y L | L I S | P L M | N P V | 2 | 8025 |
| 227 | P L M | N P V | I Y S | V K T | K Q I | 2 | 8026 |
| 228 | L M N | P V I | Y S V | K T K | Q I R | 2 | 8027 |
| 237 | K T K | Q I R | R A V | I K I | L H S | 2 | 8028 |
| 240 | Q I R | R A V | I K I | L H S | K E T | 2 | 8029 |
| 19 | T L V | T M L | S I F | W F N | V R E | 1 | 8030 |
| 35 | S F N | A C L | S H M | F F I | K F F | 1 | 8031 |
| 58 | L A M | A F D | R F V | A V S | N P L | 1 | 8032 |
| 78 | L T D | S R I | A Q I | G V A | S V I | 1 | 8033 |
| 90 | S V I | R G L | L M L | T P M | V A L | 1 | 8034 |
| 107 | R L S | Y C H | S Q V | L H H | S Y C | 1 | 8035 |
| 108 | L S Y | C H S | Q V L | H H S | Y C Y | 1 | 8036 |
| 114 | Q V L | H H S | Y C Y | H P D | V M K | 1 | 8037 |
| 121 | C Y H | P D V | M K L | S C T | D T R | 1 | 8038 |
| 136 | I N S | A V G | L T A | M F S | T V G | 1 | 8039 |
| 171 | A S P | E E R | K E T | F S T | C V S | 1 | 8040 |
| 172 | S P E | E R K | E T F | S T C | V S H | 1 | 8041 |
| 174 | E E R | K E T | F S T | C V S | H I V | 1 | 8042 |
| 176 | R K E | T F S | T C V | S H I | V A F | 1 | 8043 |
| 205 | R F G | K Q A | P A Y | V H T | M I A | 1 | 8044 |
| 206 | F G K | Q A P | A Y V | H T M | I A N | 1 | 8045 |
| 209 | Q A P | A Y V | H T M | I A N | T Y L | 1 | 8046 |
| 216 | T M I | A N T | Y L L | I S P | L M N | 1 | 8047 |
| 236 | V K T | K Q I | R R A | V I K | I L H | 1 | 8048 |

HLA-DRB1*0401 (DR4Dw4) 15-mers v.1: 238P1B2

| Pos | 1 2 3 | 4 5 6 | 7 8 9 | 0 1 2 | 3 4 5 | score | SEQ ID |
|---|---|---|---|---|---|---|---|
| 157 | L L S | Y V L | I I R | T V L | S V A | 28 | 8049 |
| 191 | A I Y | Y I P | L I S | L S I | V H R | 28 | 8050 |
| 14 | G L S | I S T | L V T | M L S | I F W | 26 | 8051 |
| 74 | Y A M | I L T | D S R | I A Q | I G V | 26 | 8052 |
| 85 | Q I G | V A S | V I R | G L L | M L T | 26 | 8053 |
| 151 | V D L | L L I | L L S | Y V L | I I R | 26 | 8054 |
| 158 | L S Y | V L I | I R T | V L S | V A S | 26 | 8055 |
| 161 | V L I | I R T | V L S | V A S | P E E | 26 | 8056 |
| 197 | L I S | L S I | V H R | F G K | Q A P | 26 | 8057 |
| 222 | Y L L | I S P | L M N | P V I | Y S V | 26 | 8058 |
| 230 | N P V | I Y S | V K T | K Q I | R R A | 26 | 8059 |
| 24 | L S I | F W F | N V R | E I S | F N A | 22 | 8060 |
| 42 | H M F | F I K | F F T | V M E | S S V | 22 | 8061 |
| 45 | F I K | F F T | V M E | S S V | L L A | 22 | 8062 |
| 46 | I K F | F T V | M E S | S V L | L A M | 22 | 8063 |
| 59 | A M A | F D R | F V A | V S N | P L R | 22 | 8064 |
| 62 | F D R | F V A | V S N | P L R | Y A M | 22 | 8065 |
| 71 | P L R | Y A M | I L T | D S R | I A Q | 22 | 8066 |
| 119 | S Y C | Y H P | D V M | K L S | C T D | 22 | 8067 |
| 143 | T A M | F S T | V G V | D L L | L I L | 22 | 8068 |
| 177 | K E T | F S T | C V S | H I V | A F A | 22 | 8069 |
| 219 | A N T | Y L L | I S P | L M N | P V I | 22 | 8070 |
| 2 | Y Y F | L S M | L S A | T D L | G L S | 20 | 8071 |
| 4 | F L S | M L S | A T D | L G L | S I S | 20 | 8072 |
| 10 | A T D | L G L | S I S | T L V | T M L | 20 | 8073 |
| 20 | L V T | M L S | I F W | F N V | R E I | 20 | 8074 |
| 23 | M L S | I F W | F N V | R E I | S F N | 20 | 8075 |
| 40 | L S H | M F F | I K F | F T V | M E S | 20 | 8076 |
| 43 | M F F | I K F | F T V | M E S | S V L | 20 | 8077 |
| 55 | S V L | L A M | A F D | R F V | A V S | 20 | 8078 |
| 57 | L L A | M A F | D R F | V A V | S N P | 20 | 8079 |
| 65 | F V A | V S N | P L R | Y A M | I L T | 20 | 8080 |
| 73 | R Y A | M I L | T D S | R I A | Q I G | 20 | 8081 |
| 80 | D S R | I A Q | I G V | A S V | I R G | 20 | 8082 |
| 92 | I R G | L L M | L T P | M V A | L L I | 20 | 8083 |
| 98 | L T P | M V A | L L I | R L S | Y C H | 20 | 8084 |
| 99 | T P M | V A L | L I R | L S Y | C H S | 20 | 8085 |
| 102 | V A L | L I R | L S Y | C H S | Q V L | 20 | 8086 |
| 105 | L I R | L S Y | C H S | Q V L | H H S | 20 | 8087 |
| 123 | H P D | V M K | L S C | T D T | R I N | 20 | 8088 |
| 126 | V M K | L S C | T D T | R I N | S A V | 20 | 8089 |
| 133 | D T R | I N S | A V G | L T A | M F S | 20 | 8090 |
| 146 | F S T | V G V | D L L | L I L | L S Y | 20 | 8091 |
| 148 | T V G | V D L | L L I | L L S | Y V L | 20 | 8092 |
| 150 | G V D | L L L | I L L | S Y V | L I I | 20 | 8093 |
| 152 | D L L | L I L | L S Y | V L I | I R T | 20 | 8094 |
| 155 | L I L | L S Y | V L I | I R T | V L S | 20 | 8095 |
| 164 | I R T | V L S | V A S | P E E | R K E | 20 | 8096 |
| 181 | S T C | V S H | I V A | F A I | Y Y I | 20 | 8097 |
| 184 | V S H | I V A | F A I | Y Y I | P L I | 20 | 8098 |
| 189 | A F A | I Y Y | I P L | I S L | S I V | 20 | 8099 |
| 192 | I Y Y | I P L | I S L | S I V | H R F | 20 | 8100 |
| 226 | S P L | M N P | V I Y | S V K | T K Q | 20 | 8101 |
| 238 | T K Q | I R R | A V I | K I L | H S K | 20 | 8102 |
| 11 | T D L | G L S | I S T | L V T | M L S | 18 | 8103 |
| 27 | F W F | N V R | E I S | F N A | C L S | 18 | 8104 |
| 47 | K F F | T V M | E S S | V L L | A M A | 18 | 8105 |
| 56 | V L L | A M A | F D R | F V A | V S N | 18 | 8106 |
| 61 | A F D | R F V | A V S | N P L | R Y A | 18 | 8107 |
| 77 | I L T | D S R | I A Q | I G V | A S V | 18 | 8108 |
| 127 | M K L | S C T | D T R | I N S | A V G | 18 | 8109 |
| 140 | V G L | T A M | F S T | V G V | D L L | 18 | 8110 |
| 168 | L S V | A S P | E E R | K E T | F S T | 18 | 8111 |
| 174 | E E R | K E T | F S T | C V S | H I V | 18 | 8112 |
| 178 | E T F | S T C | V S H | I V A | E A I | 18 | 8113 |
| 208 | K Q A | P A Y | V H T | M I A | N T Y | 18 | 8114 |

TABLE XIXC-continued part 1

| Pos | 1 2 3 | 4 5 6 | 7 8 9 | 0 1 2 | 3 4 5 | score | SEQ ID |
|---|---|---|---|---|---|---|---|
| 212 | A Y V | H T M | I A N | T Y L | L I S | 18 | 8115 |
| 213 | Y V H | T M I | A N T | Y L L | I S P | 18 | 8116 |
| 218 | I A N | T Y L | L I S | P L M | N P V | 18 | 8117 |
| 227 | P L M | N P V | I Y S | V K T | K Q I | 18 | 8118 |
| 235 | S V K | T K Q | I R R | A V I | K I L | 18 | 8119 |
| 1 | M Y Y | F L S | M L S | A T D | L G L | 16 | 8120 |
| 25 | S I F | W F N | V R E | I S F | N A C | 16 | 8121 |
| 33 | E I S | F N A | C L S | H M F | F I K | 16 | 8122 |
| 117 | H H S | Y C Y | H P D | V M K | L S C | 16 | 8123 |
| 187 | I V A | F A I | Y Y I | P L I | S L S | 16 | 8124 |
| 190 | F A I | Y Y I | P L I | S L S | I V H | 16 | 8125 |
| 203 | V H R | F G K | Q A P | A Y V | H T M | 16 | 8126 |
| 210 | A P A | Y V H | T M I | A N T | Y L L | 16 | 8127 |
| 5 | L S M | L S A | T D L | G L S | I S T | 14 | 8128 |
| 12 | D L G | L S I | S T L | V T M | L S I | 14 | 8129 |
| 17 | I S T | L V T | M L S | I F W | F N V | 14 | 8130 |
| 18 | S T L | V T M | L S I | F W F | N V R | 14 | 8131 |
| 21 | V T M | L S I | F W F | N V R | E I S | 14 | 8132 |
| 28 | W F N | V R E | I S F | N A C | L S H | 14 | 8133 |
| 48 | F F T | V M E | S S V | L L A | M A F | 14 | 8134 |
| 49 | F T V | M E S | S V L | L A M | A F D | 14 | 8135 |
| 53 | E S S | V L L | A M A | F D R | F V A | 14 | 8136 |
| 69 | S N P | L R Y | A M I | L T D | S R I | 14 | 8137 |
| 75 | A M I | L T D | S R I | A Q I | G V A | 14 | 8138 |
| 83 | I A Q | I G V | A S V | I R G | L L M | 14 | 8139 |
| 88 | V A S | V I R | G L L | M L T | P M V | 14 | 8140 |
| 89 | A S V | I R G | L L M | L T P | M V A | 14 | 8141 |
| 93 | R G L | L M L | T P M | V A L | L I R | 14 | 8142 |
| 94 | G L L | M L T | P M V | A L L | I R L | 14 | 8143 |
| 95 | L L M | L T P | M V A | L L I | R L S | 14 | 8144 |
| 103 | A L L | I R L | S Y C | H S Q | V L H | 14 | 8145 |
| 124 | P D V | M K L | S C T | D T R | I N S | 14 | 8146 |
| 137 | N S A | V G L | T A M | F S T | V G V | 14 | 8147 |
| 139 | A V G | L T A | M F S | T V G | V D L | 14 | 8148 |
| 142 | L T A | M F S | T V G | V D L | L L I | 14 | 8149 |
| 153 | L L L | I L L | S Y V | L I I | R T V | 14 | 8150 |
| 160 | Y V L | I I R | T V L | S V A | S P E | 14 | 8151 |
| 165 | R T V | L S V | A S P | E E R | K E T | 14 | 8152 |
| 185 | S H I | V A F | A I Y | Y I P | L I S | 14 | 8153 |
| 194 | Y I P | L I S | L S I | V H R | F G K | 14 | 8154 |
| 200 | L S I | V H R | F G K | Q A P | A Y V | 14 | 8155 |
| 214 | V H T | M I A | N T Y | L L I | S P L | 14 | 8156 |
| 215 | H T M | I A N | T Y L | L I S | P L M | 14 | 8157 |
| 221 | T Y L | L I S | P L M | N P V | I Y S | 14 | 8158 |
| 225 | I S P | L M N | P V I | Y S V | K T K | 14 | 8159 |
| 229 | M N P | V I Y | S V K | T K Q | I R R | 14 | 8160 |
| 6 | S M L | S A T | D L G | L S I | S T L | 12 | 8161 |
| 7 | M L S | A T D | L G L | S I S | T L V | 12 | 8162 |
| 8 | L S A | T D L | G L S | I S T | L V T | 12 | 8163 |
| 9 | S A T | D L Q | L S I | S T L | V T M | 12 | 8164 |
| 15 | L S I | S T L | V T M | L S I | F W F | 12 | 8165 |
| 29 | F N V | R E I | S F N | A C L | S H M | 12 | 8166 |
| 30 | N V R | E I S | F N A | C L S | H M F | 12 | 8167 |
| 32 | R E I | S F N | A C L | S H M | F F I | 12 | 8168 |
| 34 | I S F | N A C | L S H | M F F | I K F | 12 | 8169 |
| 39 | C L S | H M F | F I K | F F T | V M E | 12 | 8170 |
| 50 | T V M | E S S | V L L | A M A | F D R | 12 | 8171 |
| 66 | V A V | S N P | L R Y | A M I | L T D | 12 | 8172 |
| 72 | L R Y | A M I | L T D | S R I | A Q I | 12 | 8173 |
| 78 | L T D | S R I | A Q I | G V A | S V I | 12 | 8174 |
| 82 | R I A | Q I G | V A S | V I R | G L L | 12 | 8175 |
| 86 | I G V | A S V | I R G | L L M | L T P | 12 | 8176 |
| 90 | S V I | R G L | L M L | T P M | V A L | 12 | 8177 |
| 91 | V I R | G L L | M L T | P M V | A L L | 12 | 8178 |
| 97 | M L T | P M V | A L L | I R L | S Y C | 12 | 8179 |
| 104 | L L I | R L S | Y C H | S Q V | L H H | 12 | 8180 |
| 109 | S Y C | H S Q | V L H | H S Y | G Y H | 12 | 8181 |
| 110 | Y C H | S Q V | L H H | S Y C | Y H P | 12 | 8182 |
| 115 | V L H | H S Y | C Y H | P D V | M K L | 12 | 8183 |
| 130 | S C T | D T R | I N S | A V G | L T A | 12 | 8184 |
| 134 | T R I | N S A | V G L | T A M | F S T | 12 | 8185 |
| 136 | I N S | A V G | L T A | M F S | T V G | 12 | 8186 |
| 138 | S A V | C L T | A M F | S T V | G V D | 12 | 8187 |
| 145 | M F S | T V G | V D L | L L I | L L S | 12 | 8188 |
| 147 | S T V | G V D | L L L | I L L | S Y V | 12 | 8189 |
| 156 | I L L | S Y V | L I I | R T V | L S V | 12 | 8190 |
| 173 | P E E | R K E | T F S | T C V | S H I | 12 | 8191 |
| 186 | H I V | A F A | I Y Y | I P L | I S L | 12 | 8192 |
| 196 | P L I | S L S | I V H | R F G | K Q A | 12 | 8193 |
| 201 | S I V | H R F | G K Q | A P A | Y V H | 12 | 8194 |
| 206 | F G K | Q A P | A Y V | H T M | I A N | 12 | 8195 |
| 207 | G K Q | A P A | Y V H | T M I | A N T | 12 | 8196 |
| 217 | M I A | N T Y | L L I | S P L | M N P | 12 | 8197 |
| 234 | Y S V | K T K | Q I R | R A V | I K I | 12 | 8198 |
| 240 | Q I R | R A V | I K I | L H S | K E T | 12 | 8199 |
| 26 | I F W | F N V | R E I | S F N | A C L | 11 | 8200 |
| 41 | S H M | F F I | K F F | T V M | E S S | 11 | 8201 |
| 107 | R L S | Y C H | S Q V | L H H | S Y C | 10 | 8202 |
| 101 | M V A | L L I | R L S | Y C H | S Q V | 9 | 8203 |
| 159 | S Y V | L I I | R T V | L S V | A S P | 9 | 8204 |
| 199 | S L S | I V H | R F G | K Q A | P A Y | 9 | 8205 |
| 233 | I Y S | V K T | K Q I | R R A | V I K | 9 | 8206 |
| 31 | V R E | I S F | N A C | L S H | M F F | 8 | 8207 |
| 37 | N A C | L S H | M F F | I K F | F T V | 8 | 8208 |
| 54 | S S V | L L A | M A F | D R F | V A V | 8 | 8209 |
| 63 | D R F | V A V | S N P | L R Y | A M I | 8 | 8210 |
| 112 | H S Q | V L H | H S Y | C Y H | P D V | 8 | 8211 |
| 113 | S Q V | L H H | S Y C | Y H P | D V M | 8 | 8212 |
| 154 | L L I | L L S | Y V L | I I R | T V L | 8 | 8213 |
| 167 | V L S | V A S | P E E | R K E | T F S | 8 | 8214 |
| 195 | I P L | I S L | S I V | H R F | G K Q | 8 | 8215 |
| 211 | P A Y | V H T | M I A | N T Y | L L I | 8 | 8216 |
| 220 | N T Y | L L I | S P L | M N P | V I Y | 8 | 8217 |
| 129 | L S C | T D T | R I N | S A V | G L T | 7 | 8218 |
| 171 | A S P | E E R | K E T | F S T | C V S | 7 | 8219 |
| 3 | Y F L | S M L | S A T | D L G | L S I | 6 | 8220 |
| 13 | L G L | S I S | T L V | T M L | S I F | 6 | 8221 |
| 19 | T L V | T M L | S I F | W F N | V R E | 6 | 8222 |
| 22 | T M L | S I F | W F N | V R E | I S F | 6 | 8223 |
| 35 | S F N | A C L | S H M | F F I | K F F | 6 | 8224 |
| 36 | F N A | C L S | H M F | F I K | F F T | 6 | 8225 |
| 38 | A C L | S H M | F F I | K F F | T V M | 6 | 8226 |
| 44 | F F I | K F F | T V M | E S S | V L L | 6 | 8227 |
| 51 | V M E | S S V | L L A | M A F | D R F | 6 | 8228 |
| 52 | M E S | S V L | L A M | A F D | R F V | 6 | 8229 |
| 60 | M A F | D R F | V A V | S N P | L R Y | 6 | 8230 |
| 64 | R F V | A V S | N P L | R Y A | M I L | 6 | 8231 |
| 68 | V S N | P L R | Y A M | I L T | D S R | 6 | 8232 |
| 70 | N P L | R Y A | M I L | T D S | R I A | 6 | 8233 |
| 79 | T D S | R I A | Q I G | V A S | V I R | 6 | 8234 |
| 81 | S R I | A Q I | C V A | S V I | R G L | 6 | 8235 |
| 84 | A Q I | Q V A | S V I | R G L | L M L | 6 | 8236 |
| 96 | L M L | T P M | V A L | L I R | L S Y | 6 | 8237 |
| 100 | P M V | A L L | I R L | S Y C | H S Q | 6 | 8238 |
| 106 | I R L | S Y C | H S Q | V L H | H S Y | 6 | 8239 |
| 108 | L S Y | C H S | Q V L | H H S | Y C Y | 6 | 8240 |
| 111 | C H S | Q V L | H H S | Y C Y | H P D | 6 | 8241 |
| 116 | L H H | S Y C | Y H P | D V M | K L S | 6 | 8242 |
| 118 | H S Y | C Y H | P D V | M K L | S G T | 6 | 8243 |
| 120 | Y C Y | H P D | V M K | L S C | T D T | 6 | 8244 |
| 121 | C Y H | P D V | M K L | S C T | D T R | 6 | 8245 |
| 125 | D V M | K L S | C T D | T R I | N S A | 6 | 8246 |
| 128 | K L S | C T D | T R I | N S A | V G L | 6 | 8247 |
| 131 | C T D | T R I | N S A | V G L | T A M | 6 | 8248 |
| 132 | T D T | R I N | S A V | G L T | A M F | 6 | 8249 |
| 135 | R I N | S A V | G L T | A M F | S T V | 6 | 8250 |
| 144 | A M F | S T V | C V D | L L L | I L L | 6 | 8251 |
| 149 | V G V | D L L | L T L | L S Y | V L I | 6 | 8252 |
| 162 | L I T | R T V | L S V | A S P | E E R | 6 | 8253 |
| 166 | T V L | S V A | S P E | E R K | E T F | 6 | 8254 |
| 169 | S V A | S P E | E R K | E T F | S T C | 6 | 8255 |
| 172 | S P E | E R K | E T F | S T C | V S H | 6 | 8256 |
| 176 | R K E | T F S | T C V | S H I | V A F | 6 | 8257 |
| 180 | F S T | C V S | H I V | A F A | I Y Y | 6 | 8258 |
| 182 | T C V | S H I | V A F | A T Y | Y I P | 6 | 8259 |
| 183 | C V S | H I V | A F A | I Y Y | I P L | 6 | 8260 |
| 188 | V A F | A I Y | Y I P | L I S | L S I | 6 | 8261 |
| 193 | Y Y I | P L I | S L S | I V H | R F G | 6 | 8262 |
| 198 | I S L | S I V | H R F | G K Q | A P A | 6 | 8263 |
| 204 | H R F | G K Q | A P A | Y V H | T M I | 6 | 8264 |

TABLE XIXC-continued part 1

| Pos | 1 2 3 | 4 5 6 | 7 8 9 | 0 1 2 | 3 4 5 | score | SEQ ID |
|---|---|---|---|---|---|---|---|
| 205 | R F G | K Q A | P A Y | V H T | M I A | 6 | 8265 |
| 209 | Q A P | A Y V | H T M | I A N | T Y L | 6 | 8266 |
| 224 | L I S | P L M | N P V | I Y S | V K T | 6 | 8267 |
| 228 | L M N | P V I | Y S V | K T K | Q I R | 6 | 8268 |
| 232 | V I Y | S V K | T K Q | I R R | A V I | 6 | 8269 |
| 239 | K Q I | R R A | V I K | I L H | S K E | 6 | 8270 |
| 231 | P V I | Y S V | K T K | Q I R | R A V | 5 | 8271 |
| 58 | L A M | A F D | R F V | A V S | N P L | 1 | 8272 |
| 67 | A V S | N P L | R Y A | M I L | T D S | 1 | 8273 |
| 87 | G V A | S V I | R G L | L M L | T P M | 1 | 8274 |
| 122 | Y H P | D V M | K L S | C T D | T R I | 1 | 8275 |
| 170 | V A S | P E E | R K E | T F S | T C V | 1 | 8276 |
| 236 | V K T | K Q I | R R A | V I K | I L H | 1 | 8277 |
| 237 | K T K | Q I R | R A V | I K I | L H S | 1 | 8278 |
| 76 | M I L | T D S | R I A | Q I G | V A S | -5 | 8279 |
| 202 | I V H | R F G | K Q A | P A Y | V H T | -5 | 8280 |

HLA-DRB1*1101 15-mers v.1: 238P1B2

| Pos | 1 2 3 | 4 5 6 | 7 8 9 | 0 1 2 | 3 4 5 | score | SEQ ID |
|---|---|---|---|---|---|---|---|
| 24 | L S I | F W F | N V R | E I S | F N A | 27 | 8281 |
| 157 | L L S | Y V L | I I R | T V L | S V A | 25 | 8282 |
| 178 | E T F | S T C | V S H | I V A | F A I | 23 | 8283 |
| 196 | P L I | S L S | I V H | R F G | K Q A | 23 | 8284 |
| 14 | G L S | I S T | L V T | M L S | I F W | 21 | 8285 |
| 85 | Q I G | V A S | V I R | G L L | M L T | 21 | 8286 |
| 139 | A V G | L T A | M F S | T V G | V D L | 21 | 8287 |
| 46 | I K F | F T V | M E S | S V L | L A M | 20 | 8288 |
| 98 | L T P | M V A | L L I | R L S | Y C H | 20 | 8289 |
| 99 | T P M | V A L | L I R | L S Y | C H S | 20 | 8290 |
| 197 | L I S | L S I | V H R | F G K | Q A P | 20 | 8291 |
| 200 | L S I | V H R | F G K | Q A P | A Y V | 20 | 8292 |
| 231 | P V I | Y S V | K T K | Q I R | R A V | 20 | 8293 |
| 92 | I R G | L L M | L T P | M V A | L L I | 19 | 8294 |
| 119 | S Y C | Y H P | D V M | K L S | C T D | 19 | 8295 |
| 148 | T V G | V D L | L L I | L L S | Y V L | 19 | 8296 |
| 158 | L S Y | V L I | I R T | V L S | V A S | 19 | 8297 |
| 89 | A S V | I R G | L L M | L T P | M V A | 18 | 8298 |
| 102 | V A L | L I R | L S Y | C H S | Q V L | 18 | 8299 |
| 161 | V L I | I R T | V L S | V A S | P E E | 18 | 8300 |
| 25 | S I F | W F N | V R E | I S F | N A C | 17 | 8301 |
| 45 | I K F | F F T | V M E | S S V | L L A | 17 | 8302 |
| 62 | F D R | F V A | V S N | P L R | Y A M | 17 | 8303 |
| 95 | L L M | L T P | M V A | L L I | R L S | 17 | 8304 |
| 143 | T A M | F S T | V G V | D L L | L I L | 17 | 8305 |
| 190 | F A I | Y Y I | P L I | S L S | I V H | 17 | 8306 |
| 229 | M N P | V I Y | S V K | T K Q | T R R | 17 | 8307 |
| 1 | M Y Y | F L S | M L S | A T D | L G L | 16 | 8308 |
| 71 | P L R | Y A M | I L T | D S R | I A Q | 16 | 8309 |
| 191 | A I Y | Y I P | L I S | L S I | V H R | 16 | 8310 |
| 219 | A N T | Y L L | I S P | L M N | P V I | 16 | 8311 |
| 7 | M L S | A T D | L G L | S I S | T L V | 15 | 8312 |
| 56 | V L L | A M A | F D R | F V A | V S N | 15 | 8313 |
| 83 | I A Q | I G V | A S V | I R G | L L M | 15 | 8314 |
| 110 | Y C H | S Q V | L H H | S Y C | Y H P | 15 | 8315 |
| 130 | S C T | D T R | I N S | A V G | L T A | 15 | 8316 |
| 160 | Y V L | I I R | T V L | S V A | S P E | 15 | 8317 |
| 162 | L I I | R T V | L S V | A S P | E E R | 15 | 8318 |
| 233 | I Y S | V K T | K Q I | R R A | V I K | 15 | 8319 |
| 235 | S V K | T K Q | I R R | A V I | K I L | 15 | 8320 |
| 239 | K Q I | R R A | V I K | I L H | S K E | 15 | 8321 |
| 18 | S T L | V T M | L S I | F W F | N V R | 14 | 8322 |
| 34 | I S F | N A C | L S H | M F F | I K F | 14 | 8323 |
| 54 | S S V | L L A | M A F | D R F | V A V | 14 | 8324 |
| 65 | F V A | V S N | P L R | Y A M | I L T | 14 | 8325 |
| 73 | R Y A | M I L | T D S | R I A | Q I G | 14 | 8326 |
| 74 | Y A M | I L T | D S R | I A Q | I G V | 14 | 8327 |
| 109 | S Y C | H S Q | V L H | H S Y | C Y H | 14 | 8328 |
| 120 | Y C Y | H P D | V M K | L S C | T D T | 14 | 8329 |
| 127 | M K L | S C T | D T R | I N S | A V G | 14 | 8330 |
| 133 | D T R | I N S | A V G | L T A | M F S | 14 | 8331 |
| 155 | L I L | L S Y | V L I | I R T | V L S | 14 | 8332 |
| 181 | S T C | V S H | I V A | F A I | Y Y I | 14 | 8333 |
| 5 | L S M | L S A | T D L | G L S | I S T | 13 | 8334 |
| 37 | N A C | L S H | M F F | I K F | F T V | 13 | 8335 |
| 40 | L S H | M F F | I K F | F T V | M E S | 13 | 8336 |
| 48 | F F T | V M E | S S V | L L A | M A F | 13 | 8337 |
| 151 | V D L | L L I | L L S | Y V L | I I R | 13 | 8338 |
| 152 | D L L | L I L | L S Y | V L I | I R T | 13 | 8339 |
| 177 | K E T | F S T | C V S | H I V | A F A | 13 | 8340 |
| 185 | S H I | V A F | A I Y | Y I P | L I S | 13 | 8341 |
| 192 | I Y Y | I P L | I S L | S I V | H R F | 13 | 8342 |
| 208 | K Q A | P A Y | V H T | M I A | N T Y | 13 | 8343 |
| 215 | H T M | I A N | T Y L | L I S | P L M | 13 | 8344 |
| 222 | Y L L | I S P | L M N | P V I | Y S V | 13 | 8345 |
| 226 | S P L | M N P | V I Y | S V K | T K Q | 13 | 8346 |
| 240 | Q T R | R A V | T K I | L H S | K E T | 13 | 8347 |
| 2 | Y Y F | L S M | L S A | T D L | G L S | 12 | 8348 |
| 17 | I S T | L V T | M L S | T F W | F N V | 12 | 8349 |
| 20 | L V T | M L S | I F W | F N V | R E I | 12 | 8350 |
| 28 | W F N | V R E | I S F | N A C | L S H | 12 | 8351 |
| 41 | S H M | F F I | K F F | T V M | E S S | 12 | 8352 |
| 43 | M F F | I K F | F T V | M E S | S V L | 12 | 8353 |
| 50 | T V M | E S S | V L L | A M A | F D R | 12 | 8354 |
| 59 | A M A | F D R | F V A | V S N | P L R | 12 | 8355 |
| 60 | M A F | D R F | V A V | S N P | L R Y | 12 | 8356 |
| 70 | N P L | R Y A | M I L | T D S | R I A | 12 | 8357 |
| 80 | D S R | I A Q | I G V | A S V | I R G | 12 | 8358 |
| 113 | S Q V | L H H | S Y C | Y H P | D V M | 12 | 8359 |
| 123 | H P D | V M K | L S C | T D T | R I N | 12 | 8360 |
| 136 | I N S | A V G | L T A | M F S | T V G | 12 | 8361 |
| 150 | G V D | L L L | I L L | S Y V | L I I | 12 | 8362 |
| 164 | I R T | V L S | V A S | P E E | R K E | 12 | 8363 |
| 189 | A F A | I Y Y | I P L | I S L | S I V | 12 | 8364 |
| 194 | Y I P | L I S | L S I | V H R | F G K | 12 | 8365 |
| 199 | S L S | I V H | R F G | K Q A | P A Y | 12 | 8366 |
| 211 | P A Y | V H T | M I A | N T Y | L L I | 12 | 8367 |
| 220 | N T Y | L L I | S P L | M N P | V I Y | 12 | 8368 |
| 230 | N P V | I Y S | V K T | K Q I | R R A | 12 | 8369 |
| 26 | I F W | F N V | R E I | S F N | A C L | 11 | 8370 |
| 187 | I V A | F A I | Y Y I | P L I | S L S | 11 | 8371 |
| 234 | Y S V | K T K | Q I R | R A V | I K I | 11 | 8372 |
| 33 | E I S | F N A | C L S | H M F | F I K | 10 | 8373 |
| 42 | H M F | F I K | F F T | V M E | S S V | 10 | 8374 |
| 107 | R L S | Y C H | S Q V | L H H | S Y C | 10 | 8375 |
| 117 | H H S | Y C Y | H P D | V M K | L S C | 10 | 8376 |
| 203 | V H R | F G K | Q A P | A Y V | H T M | 10 | 8377 |
| 207 | G K Q | A P A | Y V H | T M I | A N T | 10 | 8378 |
| 210 | A P A | Y V H | T M I | A N T | Y L L | 10 | 8379 |
| 44 | F F I | K F F | T V M | E S S | V L L | 9 | 8380 |
| 63 | D R F | V A V | S N P | L R Y | A M I | 9 | 8381 |
| 142 | L T A | M F S | T V G | V D L | L L I | 9 | 8382 |
| 154 | L L I | L L S | Y V L | I I R | T V L | 9 | 8383 |
| 238 | T K Q | I R R | A V I | K I L | H S K | 9 | 8384 |
| 15 | L S I | S T L | V T M | L S I | F W F | 8 | 8385 |
| 23 | M L S | I F W | F N V | R E I | S F N | 8 | 8386 |
| 39 | C L S | H M F | F I K | F F T | V M E | 8 | 8387 |
| 49 | F T V | M E S | S V L | L A M | A F D | 8 | 8388 |
| 58 | L A M | A F D | R F V | A V S | N P L | 8 | 8389 |
| 72 | L R Y | A M I | L T D | S R I | A Q I | 8 | 8390 |
| 75 | A M I | L T D | S R I | A Q I | G V A | 8 | 8391 |
| 86 | I G V | A S V | I R G | L L M | L T P | 8 | 8392 |
| 104 | L L I | R L S | Y C H | S Q V | L H H | 8 | 8393 |
| 108 | L S Y | C H S | Q V L | H H S | Y C Y | 8 | 8394 |
| 115 | V L H | H S Y | C Y H | P D V | M K L | 8 | 8395 |
| 126 | V M K | L S C | T D T | R I N | S A V | 8 | 8396 |
| 128 | K L S | C T D | T R I | N S A | V G L | 8 | 8397 |
| 146 | F S T | V G V | D L L | L I L | L S Y | 8 | 8398 |
| 156 | I L L | S Y V | L I I | R T V | L S V | 8 | 8399 |
| 167 | V L S | V A S | P E E | R K E | T F S | 8 | 8400 |
| 168 | L S V | A S P | E E R | K E T | F S T | 8 | 8401 |
| 169 | S V A | S P E | E R K | E T F | S T C | 8 | 8402 |
| 195 | I P L | I S L | S I V | H R F | G K Q | 8 | 8403 |
| 212 | A Y V | H T M | I A N | T Y L | L T S | 8 | 8404 |
| 217 | M I A | N T Y | L L I | S P L | M N P | 8 | 8405 |
| 225 | I S P | L M N | P V I | Y S V | K T K | 8 | 8406 |
| 227 | P L M | N P V | I Y S | V K T | K Q I | 8 | 8407 |
| 3 | Y F L | S M L | S A T | D L G | L S I | 7 | 8408 |
| 10 | A T D | L G L | S I S | T L V | T M L | 7 | 8409 |
| 11 | T D L | G L S | I S T | L V T | M L S | 7 | 8410 |
| 21 | V T M | L S I | F W F | N V R | E I S | 7 | 8411 |

TABLE XIXC-continued part 1

| Pos | 1 2 3 | 4 5 6 | 7 8 9 | 0 1 2 | 3 4 5 | score | SEQ ID |
|---|---|---|---|---|---|---|---|
| 30 | N V R | E I S | F N A | C L S | H M F | 7 | 8412 |
| 51 | V M E | S S V | L L A | M A F | D R F | 7 | 8413 |
| 55 | S V L | L A M | A F D | R F V | A V S | 7 | 8414 |
| 64 | R F V | A V S | N P L | R Y A | M I L | 7 | 8415 |
| 76 | M I L | T D S | R I A | Q I G | V A S | 7 | 8416 |
| 78 | L T D | S R I | A Q I | G V A | S V I | 7 | 8417 |
| 82 | R I A | Q I G | V A S | V I R | G L L | 7 | 8418 |
| 88 | V A S | V I R | G L L | M L T | P M V | 7 | 8419 |
| 94 | G L L | M L T | P M V | A L L | I R L | 7 | 8420 |
| 96 | L M L | T P M | V A L | L I R | L S Y | 7 | 8421 |
| 105 | L I R | L S Y | C H S | Q V L | H H S | 7 | 8422 |
| 121 | C Y H | P D V | M K L | S C T | D T R | 7 | 8423 |
| 145 | M F S | T V G | V D L | L L I | L L S | 7 | 8424 |
| 147 | S T V | G V D | L L L | I L L | S Y V | 7 | 8425 |
| 153 | L L L | I L L | S Y V | L I I | R T V | 7 | 8426 |
| 165 | R T V | L S V | A S P | E E R | K E T | 7 | 8427 |
| 174 | E E R | K E T | F S T | C V S | H I V | 7 | 8428 |
| 182 | T C V | S H I | V A F | A I Y | Y I P | 7 | 8429 |
| 186 | H I V | A F A | I Y Y | I P L | I S L | 7 | 8430 |
| 188 | V A F | A I Y | Y I P | L I S | L S I | 7 | 8431 |
| 214 | V H T | M I A | N T Y | L L I | S P L | 7 | 8432 |
| 218 | I A N | T Y L | L I S | P L M | N P V | 7 | 8433 |
| 223 | L L I | S P L | M N P | V I Y | S V K | 7 | 8434 |
| 4 | F L S | M L S | A T D | L G L | S I S | 6 | 8435 |
| 9 | S A T | D L G | L S I | S T L | V T M | 6 | 8436 |
| 12 | D L G | L S I | S T L | V T M | L S I | 6 | 8437 |
| 27 | F W F | N V R | E I S | F N A | C L S | 6 | 8438 |
| 31 | V R E | I S F | N A C | L S H | M F F | 6 | 8439 |
| 52 | M E S | S V L | L A M | A F D | R F V | 6 | 8440 |
| 53 | E S S | V L L | A M A | F D R | F V A | 6 | 8441 |
| 57 | L L A | M A F | D R F | V A V | S N P | 6 | 8442 |
| 66 | V A V | S N P | L R Y | A M I | L T D | 6 | 8443 |
| 69 | S N P | L R Y | A M I | L T D | S R I | 6 | 8444 |
| 77 | I L T | D S R | I A Q | I G V | A S V | 6 | 8445 |
| 79 | T D S | R I A | Q I G | V A S | V I R | 6 | 8446 |
| 90 | S V I | R G L | L M L | T P M | V A L | 6 | 8447 |
| 91 | V I R | G L L | M L T | P M V | A L L | 6 | 8448 |
| 93 | R G L | L M L | T P M | V A L | L I R | 6 | 8449 |
| 100 | P M V | A L L | I R L | S Y C | H S Q | 6 | 8450 |
| 101 | M V A | L L I | R L S | Y C H | S Q V | 6 | 8451 |
| 103 | A L L | I R L | S Y C | H S Q | V L H | 6 | 8452 |
| 112 | H S Q | V L H | H S Y | C Y H | P D V | 6 | 8453 |
| 124 | P D V | M K L | S C T | D T R | I N S | 6 | 8454 |
| 134 | T R I | N S A | V G L | T A M | F S T | 6 | 8455 |
| 137 | N S A | V G L | T A M | F S T | V G V | 6 | 8456 |
| 144 | A M F | S T V | G V D | L L L | I L L | 6 | 8457 |
| 149 | V G V | D L L | L I L | L S Y | V L I | 6 | 8458 |
| 159 | S Y V | L I I | R T V | L S V | A S P | 6 | 8459 |
| 170 | V A S | P E E | R K E | T F S | T C V | 6 | 8460 |
| 180 | F S T | C V S | H I V | A F A | I Y Y | 6 | 8461 |
| 184 | V S H | I V A | F A I | Y Y I | P L I | 6 | 8462 |
| 201 | S I V | H R F | G K Q | A P A | Y V H | 6 | 8463 |
| 216 | T M I | A N T | Y L L | I S P | L M N | 6 | 8464 |
| 221 | T Y L | L I S | P L M | N P V | I Y S | 6 | 8465 |
| 224 | L I S | P L M | N P V | I Y S | V K T | 6 | 8466 |
| 61 | A F D | R F V | A V S | N P L | R Y A | 4 | 8467 |
| 81 | S R I | A Q I | G V A | S V I | R G L | 3 | 8468 |
| 84 | A Q I | G V A | S V I | R G L | L M L | 3 | 8469 |
| 97 | M L T | P M V | A L L | I R L | S Y C | 3 | 8470 |
| 16 | S I S | T L V | T M L | S I F | W F N | 2 | 8471 |
| 22 | T M L | S I F | W F N | V R E | I S F | 2 | 8472 |
| 125 | D V M | K L S | C T D | T R I | N S A | 2 | 8473 |
| 163 | I I R | T V L | S V A | S P E | E R K | 2 | 8474 |
| 166 | T V L | S V A | S P E | E R K | E T F | 2 | 8475 |
| 175 | E R K | E T F | S T C | V S H | I V A | 2 | 8476 |
| 198 | I S L | S I V | H R F | G K Q | A P A | 2 | 8477 |
| 232 | V I Y | S V K | T K Q | I R R | A V I | 2 | 8478 |
| 32 | R E I | S F N | A C L | S H M | F F I | 1 | 8479 |
| 36 | F N A | C L S | H M F | F I K | F F T | 1 | 8480 |
| 47 | K F F | T V M | E S S | V L L | A M A | 1 | 8481 |
| 67 | A V S | N P L | R Y A | M I L | T D S | 1 | 8482 |
| 68 | V S N | P L R | Y A M | I L T | D S R | 1 | 8483 |
| 106 | I R L | S Y C | H S Q | V L H | H S Y | 1 | 8484 |
| 116 | L H H | S Y C | Y H P | D V M | K L S | 1 | 8485 |
| 118 | H S Y | C Y H | P D V | M K L | S C T | 1 | 8486 |
| 132 | T D T | R I N | S A V | G L T | A M F | 1 | 8487 |
| 135 | R I N | S A V | G L T | A M F | S T V | 1 | 8488 |
| 141 | G L T | A M F | S T V | G V D | L L L | 1 | 8489 |
| 176 | R K E | T F S | T C V | S H I | V A F | 1 | 8490 |
| 179 | T F S | T C V | S H I | V A F | A I Y | 1 | 8491 |
| 183 | C V S | H I V | A F A | I Y Y | I P L | 1 | 8492 |
| 193 | Y Y I | P L I | S L S | I V H | R F G | 1 | 8493 |
| 202 | I V H | R F G | P Q A | P A Y | V H T |   | 8494 |

TABLE XIXC part 2

| Pos | 1 2 3 | 4 5 6 | 7 8 9 | 0 1 2 | 3 4 5 | score | SEQ ID |
|---|---|---|---|---|---|---|---|
| H2-Ak 15-mers, v.1B |   |   |   |   |   |   |   |
| 2 | I T S | T L Q | N I T | S T S | I I F | 16 | 8495 |
| 15 | I F L | L T G | V P G | L E A | F H T | 16 | 8496 |
| 48 | L I L | F A T | I T Q | P S L | H E P | 14 | 8497 |
| 53 | T I T | Q P S | L H E | P M Y | Y F L | 14 | 8498 |
| 61 | E P M | Y Y F | L S M | L S A | T D L | 14 | 8499 |
| 43 | L L G | N S L | I L F | A T I | T Q P | 12 | 8500 |
| 12 | T S I | I F L | L T G | V P G | L E A | 10 | 8501 |
| 21 | V P G | L E A | F H T | W I S | I P F | 10 | 8502 |
| 47 | S L I | L F A | T I T | Q P S | L H E | 10 | 8503 |
| 8 | N I T | S T S | I I F | L L T | G V P | 8 | 8504 |
| 9 | I T S | T S I | I F L | L T G | V P G | 8 | 8505 |
| 11 | S T S | I I F | L L T | G V P | G L E | 8 | 8506 |
| 17 | L L T | G V P | G L E | A F H | T W I | 8 | 8507 |
| 18 | L T G | V P G | L E A | F H T | W I S | 8 | 8508 |
| 28 | H T W | I S I | P F C | F L S | V T A | 8 | 8509 |
| 31 | I S I | P F C | F L S | V T A | L L G | 8 | 8510 |
| 34 | P F C | F L S | V T A | L L G | N S L | 8 | 8511 |
| 36 | C F L | S V T | A L L | G N S | L I L | 8 | 8512 |
| 37 | F L S | V T A | L L G | N S L | I L F | 8 | 8513 |
| 41 | T A L | L G N | S L I | L F A | T I T | 8 | 8514 |
| 42 | A L L | G N S | L I L | F A T | I T Q | 8 | 8515 |
| 44 | L G N | S L I | L F A | T I T | Q P S | 8 | 8516 |
| 57 | P S L | H E P | M Y Y | F L S | M L S | 8 | 8517 |
| 60 | H E P | M Y Y | F L S | M L S | A T D | 8 | 8518 |
| 3 | T S T | L Q N | I T S | T S I | I F L | 6 | 8519 |
| 5 | T L Q | N I T | S T S | I I F | L L T | 6 | 8520 |
| 25 | E A F | H T W | I S I | P F C | F L S | 6 | 8521 |
| 27 | F H T | W I S | I P F | C F L | S V T | 6 | 8522 |
| 32 | S I P | F C F | L S V | T A L | L G N | 6 | 8523 |
| 38 | L S V | T A L | L G N | S L I | L F A | 6 | 8524 |
| 40 | V T A | L L G | N S L | I L F | A T I | 6 | 8525 |
| 45 | G N S | L I L | F A T | I T Q | P S L | 4 | 8526 |
| 1 | F I T | S T L | Q N I | T S T | S I I | 2 | 8527 |
| 4 | S T L | Q N I | T S T | S I I | F L L | 2 | 8528 |
| 30 | W I S | I P F | C F L | S V T | A L L | 2 | 8529 |
| 33 | I P F | C F L | S V T | A L L | G N S | 2 | 8530 |
| 62 | P M Y | Y F L | S M L | S A T | D L G | 2 | 8531 |
| H2-Ek 15-mers, v.1B |   |   |   |   |   |   |   |
| 12 | T S I | I F L | L T G | V P G | L E A | 20 | 8532 |
| 15 | I F L | L T G | V P G | L E A | F H T | 20 | 8533 |
| 18 | L T G | V P G | L E A | F H T | W I S | 20 | 8534 |
| 37 | F L S | V T A | L L G | N S L | I L F | 20 | 8535 |
| 3 | T S T | L Q N | I T S | T S I | I F L | 16 | 8536 |
| 11 | S T S | I I F | L L T | G V P | G L E | 16 | 8537 |
| 21 | V P G | L E A | F H T | W I S | I P F | 16 | 8538 |
| 34 | P F C | F L S | V T A | L L G | N S L | 16 | 8539 |
| 41 | T A L | L G N | S L I | L F A | T I T | 16 | 8540 |
| 45 | G N S | L I L | F A T | I T Q | P S L | 16 | 8541 |
| 48 | L I L | F A T | I T Q | P S L | H E P | 16 | 8542 |
| 27 | F H T | W I S | I P F | C F L | S V T | 12 | 8543 |
| 32 | S I P | F C F | L S V | T A L | L G N | 12 | 8544 |
| 61 | E P M | Y Y F | L S M | L S A | T D L | 12 | 8545 |
| 62 | P M Y | Y F L | S M L | S A T | D L G | 12 | 8546 |

TABLE XIXC-continued part 2

| Pos | 1 2 3 | 4 5 6 | 7 8 9 | 0 1 2 | 3 4 5 | score | SEQ ID |
|---|---|---|---|---|---|---|---|
| 6 | L Q N | I T S | T S I | I F L | L T G | 10 | 8547 |
| 14 | I I F | L L T | G V P | G L E | A F H | 10 | 8548 |
| 28 | H T W | I S I | P F C | F L S | V T A | 10 | 8549 |
| 30 | W I S | I P F | C F L | S V T | A L L | 10 | 8550 |
| 35 | F C F | L S V | T A L | L G N | S L I | 10 | 8551 |
| 38 | L S V | T A L | L G N | S L I | L F A | 10 | 8552 |
| 40 | V T A | L L G | N S L | I L F | A T I | 10 | 8553 |
| 44 | L G N | S L I | L F A | T I T | Q P S | 10 | 8554 |
| 46 | N S L | I L F | A T I | T Q P | S L H | 10 | 8555 |
| 47 | S L I | L F A | T I T | Q P S | L H E | 10 | 8556 |
| 51 | F A T | I T Q | P S L | H E P | M Y Y | 10 | 8557 |
| 53 | T I T | Q P S | L H E | P M Y | Y F L | 10 | 8558 |
| 56 | Q P S | L H E | P M Y | Y F L | S M L | 10 | 8559 |
| 5 | T L Q | N I T | S T S | I I F | L L T | 6 | 8560 |
| 7 | Q N I | T S T | S I I | F L L | T G V | 6 | 8561 |
| 8 | N I T | S T S | I I F | L L T | G V P | 6 | 8562 |
| 9 | I T S | T S I | I F L | L T G | V P G | 6 | 8563 |
| 10 | T S T | S I I | F L L | T G V | P G L | 6 | 8564 |
| 13 | S I I | F L L | T G V | P G L | E A F | 6 | 8565 |
| 24 | L E A | F H T | W I S | I P F | C F L | 6 | 8566 |
| 25 | E A F | H T W | I S I | P F C | F L S | 6 | 8567 |
| 26 | A F H | T W I | S I P | F C F | L S V | 6 | 8568 |
| 29 | T W I | S I P | F C F | L S V | T A L | 6 | 8569 |
| 31 | I S I | P F C | F L S | V T A | L L G | 6 | 8570 |
| 33 | I P F | C F L | S V T | A L L | G N S | 6 | 8571 |
| 42 | A L L | G N S | L I L | F A T | I T Q | 6 | 8572 |
| 43 | L L G | N S L | I L F | A T I | T Q P | 6 | 8573 |
| 52 | A T I | T Q P | S L H | E P M | Y Y F | 6 | 8574 |
| 60 | H E P | M Y Y | F L S | M L S | A T D | 6 | 8575 |
| 17 | L L T | G V P | G L E | A F H | T W I | 4 | 8576 |

HLA-DRB1*0101 15-mers, v.1B: 238P1B2

| Pos | 1 2 3 | 4 5 6 | 7 8 9 | 0 1 2 | 3 4 5 | score | SEQ ID |
|---|---|---|---|---|---|---|---|
| 37 | F L S | V T A | L L G | N S L | I L F | 33 | 8577 |
| 11 | S T S | I I F | L L T | G V P | G L E | 31 | 8578 |
| 15 | I F L | L T G | V P G | L E A | F H T | 31 | 8579 |
| 3 | T S T | L Q N | I T S | T S I | I F L | 29 | 8580 |
| 32 | S I P | F C F | L S V | T A L | L G N | 28 | 8581 |
| 61 | E P M | Y Y F | L S M | L S A | T D L | 27 | 8582 |
| 12 | T S I | I F L | L T G | V P G | L E A | 25 | 8583 |
| 18 | L T G | V P G | L E A | F H T | W I S | 25 | 8584 |
| 24 | L E A | F H T | W I S | I P F | C F L | 24 | 8585 |
| 27 | F H T | W I S | I P F | C F L | S V T | 24 | 8586 |
| 34 | P F C | F L S | V T A | L L G | N S L | 24 | 8587 |
| 48 | L I L | F A T | I T Q | P S L | H E P | 24 | 8588 |
| 13 | S I I | F L L | T G V | P G L | E A F | 22 | 8589 |
| 21 | V P G | L E A | F H T | W I S | I P F | 22 | 8590 |
| 47 | S L I | L F A | T I T | Q P S | L H E | 22 | 8591 |
| 60 | H E P | M Y Y | F L S | M L S | A T D | 22 | 8592 |
| 44 | L G N | S L I | L F A | T I T | Q P S | 20 | 8593 |
| 28 | H T W | I S I | P F C | F L S | V T A | 19 | 8594 |
| 4 | S T L | Q N I | T S T | S I I | F L L | 18 | 8595 |
| 38 | L S V | T A L | L G N | S L I | L F A | 18 | 8596 |
| 46 | N S L | I L F | A T I | T Q P | S L H | 18 | 8597 |
| 6 | L Q N | I T S | T S I | I F L | L T G | 17 | 8598 |
| 26 | A F H | T W I | S I P | F C F | L S V | 17 | 8599 |
| 51 | F A T | I T Q | P S L | H E P | M Y Y | 17 | 8600 |
| 40 | V T A | L L G | N S L | I L F | A T I | 16 | 8601 |
| 41 | T A L | L G N | S L I | L F A | T I T | 16 | 8602 |
| 56 | Q P S | L H E | P M Y | Y F L | S M L | 16 | 8603 |
| 33 | I P F | C F L | S V T | A L L | G N S | 15 | 8604 |
| 39 | S V T | A L L | G N S | L I L | F A T | 15 | 8605 |
| 43 | L L G | N S L | I L F | A T I | T Q P | 15 | 8606 |
| 45 | G N S | L I L | F A T | I T Q | P S L | 15 | 8607 |
| 2 | I T S | T L Q | N I T | S T S | I I F | 14 | 8608 |
| 5 | T L Q | N I T | S T S | I I F | L L T | 14 | 8609 |
| 10 | T S T | S I I | F L L | T G V | P G L | 14 | 8610 |
| 14 | I I F | L L T | G V P | G L E | A F H | 14 | 8611 |
| 31 | I S I | P F C | F L S | V T A | L L G | 14 | 8612 |
| 57 | P S L | H E P | M Y Y | F L S | M L S | 14 | 8613 |
| 50 | L F A | T I T | Q P S | L H E | P M Y | 12 | 8614 |
| 62 | P M Y | Y F L | S M L | S A T | D L G | 11 | 8615 |
| 35 | F C F | L S V | T A L | L G N | S L I | 10 | 8616 |
| 49 | I L F | A T I | T Q P | S L H | E P M | 10 | 8617 |
| 1 | F I T | S T L | Q N I | T S T | S I I | 9 | 8618 |

TABLE XIXC-continued part 2

| Pos | 1 2 3 | 4 5 6 | 7 8 9 | 0 1 2 | 3 4 5 | score | SEQ ID |
|---|---|---|---|---|---|---|---|
| 9 | I T S | T S I | I F L | L T G | V P G | 9 | 8619 |
| 16 | F L L | T G V | P G L | E A F | H T W | 9 | 8620 |
| 20 | G V P | G L E | A F H | T W I | S I P | 9 | 8621 |
| 22 | P G L | E A F | H T W | I S I | P F C | 9 | 8622 |
| 30 | W I S | I P F | C F L | S V T | A L L | 9 | 8623 |
| 36 | C F L | S V T | A L L | G N S | L I L | 9 | 8624 |
| 42 | A L L | G N S | L I L | F A T | I T Q | 9 | 8625 |
| 58 | S L H | E P M | Y Y F | L S M | L S A | 9 | 8626 |
| 7 | Q N I | T S T | S I I | F L L | T G V | 8 | 8627 |
| 23 | G L E | A F H | T W I | S I P | F C F | 8 | 8628 |
| 29 | T W I | S I P | F C F | L S V | T A L | 8 | 8629 |
| 52 | A T I | T Q P | S L H | E P M | Y Y F | 8 | 8630 |
| 53 | T I T | Q P S | L H E | P M Y | Y F L | 8 | 8631 |
| 54 | I T Q | P S L | H E P | M Y Y | F L S | 8 | 8632 |
| 55 | T Q P | S L H | E P M | Y Y F | L S M | 8 | 8633 |
| 59 | L H E | P M Y | Y F L | S M L | S A T | 8 | 8634 |
| 8 | N I T | S T S | I I F | L L T | G V P | 7 | 8635 |
| 25 | E A F | H T W | I S I | P F C | F L S | 7 | 8636 |
| 17 | L L T | G V P | G L E | A F H | T W I | 1 | 8637 |
| 19 | T G V | P G L | E A F | H T W | I S I | 1 | 8638 |

HLA-DRB1*0301 (DR17) 15-mers, v.1B: 238P1B2

| Pos | 1 2 3 | 4 5 6 | 7 8 9 | 0 1 2 | 3 4 5 | score | SEQ ID |
|---|---|---|---|---|---|---|---|
| 40 | V T A | L L G | N S L | I L F | A T I | 22 | 8639 |
| 48 | L I L | F A T | I T Q | P S L | H E P | 22 | 8640 |
| 6 | L Q N | I T S | T S I | I F L | L T G | 21 | 8641 |
| 37 | F L S | V T A | L L G | N S L | I L F | 21 | 8642 |
| 13 | S I I | F L L | T G V | P G L | E A F | 20 | 8643 |
| 56 | Q P S | L H E | P M Y | Y F L | S M L | 19 | 8644 |
| 32 | S I P | F C F | L S V | T A L | L C N | 18 | 8645 |
| 24 | L E A | F H T | W I S | I P F | C F L | 16 | 8646 |
| 53 | T I T | Q P S | L H E | P M Y | Y F L | 15 | 8647 |
| 14 | I I F | L L T | G V P | G L E | A F H | 13 | 8648 |
| 15 | I F L | L T G | V P G | L E A | F H T | 13 | 8649 |
| 34 | P F C | F L S | V T A | L L G | N S L | 13 | 8650 |
| 11 | S T S | I I F | L L T | G V P | G L E | 12 | 8651 |
| 12 | T S I | I F L | L T G | V P G | L E A | 12 | 8652 |
| 39 | S V T | A L L | G N S | L I L | F A T | 12 | 8653 |
| 41 | T A L | L G N | S L I | L F A | T I T | 12 | 8654 |
| 45 | G N S | L I L | F A T | I T Q | P S L | 12 | 8655 |
| 46 | N S L | I L F | A T I | T Q P | S L H | 12 | 8656 |
| 51 | F A T | I T Q | P S L | H E P | M Y Y | 12 | 8657 |
| 60 | H E P | M Y Y | F L S | M L S | A T D | 12 | 8658 |
| 18 | L T G | V P G | L E A | F H T | W I S | 11 | 8659 |
| 27 | F H T | W I S | I P F | C F L | S V T | 11 | 8660 |
| 28 | H T W | I S I | P F C | F L S | V T A | 11 | 8661 |
| 33 | I P F | C F L | S V T | A L L | G N S | 11 | 8662 |
| 35 | F C F | L S V | T A L | L G N | S L I | 11 | 8663 |
| 47 | S L I | L F A | T I T | Q P S | L H E | 11 | 8664 |
| 55 | T Q P | S L H | E P M | Y Y F | L S M | 11 | 8665 |
| 3 | T S T | L Q N | I T S | T S I | I F L | 10 | 8666 |
| 16 | F L L | T G V | P G L | E A F | H T W | 10 | 8667 |
| 17 | L L T | G V P | G L E | A F H | T W I | 10 | 8668 |
| 21 | V P G | L E A | F H T | W I S | I P F | 10 | 8669 |
| 30 | W I S | I P F | C F L | S V T | A L L | 10 | 8670 |
| 54 | I T Q | P S L | H E P | M Y Y | F L S | 10 | 8671 |
| 5 | T L Q | N I T | S T S | I I F | L L T | 9 | 8672 |
| 7 | Q N I | T S T | S I I | F L L | T G V | 9 | 8673 |
| 38 | L S V | T A L | L G N | S L I | L F A | 9 | 8674 |
| 26 | A F H | T W I | S I P | F C F | L S V | 8 | 8675 |
| 59 | L H E | P M Y | Y F L | S M L | S A T | 8 | 8676 |
| 8 | N I T | S T S | I I F | L L T | G V P | 4 | 8677 |
| 20 | G V P | G L E | A F H | T W I | S I P | 3 | 8678 |
| 29 | T W I | S I P | F C F | L S V | T A L | 3 | 8679 |
| 36 | C F L | S V T | A L L | G N S | L I L | 3 | 8680 |
| 43 | L L G | N S L | I L F | A T I | T Q P | 3 | 8681 |
| 50 | L F A | T I T | Q P S | L H E | P M Y | 3 | 8682 |
| 1 | F I T | S T L | Q N I | T S T | S I I | 2 | 8683 |
| 2 | I T S | T L Q | N I T | S T S | I I F | 2 | 8684 |
| 10 | T S T | S I I | F L L | T G V | P G L | 2 | 8685 |
| 25 | E A F | H T W | I S I | P F C | F L S | 2 | 8686 |
| 31 | I S I | P F C | F L S | V T A | L L G | 2 | 8687 |
| 42 | A L L | G N S | L I L | F A T | I T Q | 2 | 8688 |
| 44 | L G N | S L I | L F A | T I T | Q P S | 2 | 8689 |
| 49 | I L F | A T I | T Q P | S L H | E P M | 2 | 8690 |

TABLE XIXC-continued part 2

| Pos | 1 2 3 | 4 5 6 | 7 8 9 | 0 1 2 | 3 4 5 | score | SEQ ID |
|---|---|---|---|---|---|---|---|
| 52 | A T I | T Q P | S L H | E P M | Y Y F | 2 | 8691 |
| 57 | P S L | H E P | M Y Y | F L S | M L S | 2 | 8692 |
| 58 | S L H | E P M | Y Y F | L S M | L S A | 2 | 8693 |
| 61 | E P M | Y Y F | L S M | L S A | T D L | 2 | 8694 |
| 62 | P M Y | Y F L | S M L | S A T | D L G | 2 | 8695 |
| 4 | S T L | Q N I | T S T | S I I | F L L | 1 | 8696 |
| 9 | I T S | T S I | I F L | L T G | V P G | 1 | 8697 |
| 19 | T G V | P G L | E A F | H T W | I S I | 1 | 8698 |

HLA-DRB1*0401 (DR4Dw4) 15-mers, v.1B: 238P1B2

| Pos | 1 2 3 | 4 5 6 | 7 8 9 | 0 1 2 | 3 4 5 | score | SEQ ID |
|---|---|---|---|---|---|---|---|
| 48 | L I L | F A T | I T Q | P S L | H E P | 28 | 8699 |
| 3 | T S T | L Q N | I T S | T S I | I F L | 26 | 8700 |
| 21 | V P G | L E A | F H T | W I S | I P F | 26 | 8701 |
| 45 | G N S | L I L | F A T | I T Q | P S L | 26 | 8702 |
| 60 | H E P | M Y Y | F L S | M L S | A T D | 26 | 8703 |
| 27 | F H T | W I S | I P F | C F L | S V T | 22 | 8704 |
| 32 | S I P | F C F | L S V | T A L | L G N | 22 | 8705 |
| 61 | E P M | Y Y F | L S M | L S A | T D L | 22 | 8706 |
| 11 | S T S | I I F | L L T | G V P | G L E | 20 | 8707 |
| 15 | I F L | L T G | V P G | L E A | F H T | 20 | 8708 |
| 18 | L T G | V P C | L E A | F H T | W I S | 20 | 8709 |
| 37 | F L S | V T A | L L G | N S L | I L F | 20 | 8710 |
| 47 | S L I | L F A | T I T | Q P S | L H E | 20 | 8711 |
| 20 | C V P | G L E | A F H | T W I | S I P | 18 | 8712 |
| 31 | I S I | P F C | F L S | V T A | L L G | 18 | 8713 |
| 38 | L S V | T A L | L G N | S L I | L F A | 18 | 8714 |
| 13 | S I I | F L L | T G V | P G L | E A F | 16 | 8715 |
| 24 | L E A | F H T | W I S | I P F | C F L | 16 | 8716 |
| 34 | P F C | F L S | V T A | L L G | N S L | 16 | 8717 |
| 62 | P M Y | Y F L | S M L | S A T | D L G | 16 | 8718 |
| 6 | L Q N | I T S | T S I | I F L | L T G | 14 | 8719 |
| 12 | T S I | I F L | L T G | V P G | L E A | 14 | 8720 |
| 28 | H T W | I S I | P F C | F L S | V T A | 14 | 8721 |
| 30 | W I S | I P F | C F L | S V T | A L L | 14 | 8722 |
| 35 | F C F | L S V | T A L | L G N | S L I | 14 | 8723 |
| 41 | T A L | L G N | S L I | L F A | T I T | 14 | 8724 |
| 46 | N S L | I L F | A T I | T Q P | S L H | 14 | 8725 |
| 56 | Q P S | L H E | P M Y | Y F L | S M L | 14 | 8726 |
| 2 | I T S | T L Q | N I T | S T S | I I F | 12 | 8727 |
| 4 | S T L | Q N I | T S T | S I I | F L L | 12 | 8728 |
| 8 | N I T | S T S | I I F | L L T | G V P | 12 | 8729 |
| 10 | T S T | S I I | F L L | T G V | P G L | 12 | 8730 |
| 29 | T W I | S I P | F C F | L S V | T A L | 12 | 8731 |
| 33 | I P F | C F L | S V T | A L L | G N S | 12 | 8732 |
| 36 | C F L | S V T | A L L | G N S | L I L | 12 | 8733 |
| 39 | S V T | A L L | C N S | L I L | F A T | 12 | 8734 |
| 42 | A L L | G N S | L I L | F A T | I T Q | 12 | 8735 |
| 43 | L L G | N S L | I L F | A T I | T Q P | 12 | 8736 |
| 44 | L G N | S L I | L F A | T I T | Q P S | 12 | 8737 |
| 52 | A T I | T Q P | S L H | E P M | Y Y F | 12 | 8738 |
| 14 | I I F | L L T | G V P | G L E | A F H | 8 | 8739 |
| 40 | V T A | L L G | N S L | I L F | A T I | 8 | 8740 |
| 51 | F A T | I T Q | P S L | H E P | M Y Y | 8 | 8741 |
| 1 | F I T | S T L | Q N I | T S T | S I I | 6 | 8742 |
| 5 | T L Q | N I T | S T S | I I F | L L T | 6 | 8743 |
| 7 | Q N I | T S T | S I I | F L L | T G V | 6 | 8744 |
| 9 | I T S | T S I | I F L | L T G | V P G | 6 | 8745 |
| 19 | T G V | P G L | E A F | H T W | I S I | 6 | 8746 |
| 22 | P G L | E A F | H T W | I S I | P F C | 6 | 8747 |
| 25 | E A F | H T W | I S I | P F C | F L S | 6 | 8748 |
| 50 | L F A | T I T | Q P S | L H E | P M Y | 6 | 8749 |
| 53 | T I T | Q P S | L H E | P M Y | Y F L | 6 | 8750 |
| 55 | T Q P | S L H | E P M | Y Y F | L S M | 6 | 8751 |
| 57 | P S L | H E P | M Y Y | F L S | M L S | 6 | 8752 |
| 58 | S L H | E P M | Y Y F | L S M | L S A | 6 | 8753 |
| 59 | L H E | P M Y | Y F L | S M L | S A T | 6 | 8754 |

HLA-DRB1*1101 15-mers, v.1B: 238P1B2

| Pos | 1 2 3 | 4 5 6 | 7 8 9 | 0 1 2 | 3 4 5 | score | SEQ ID |
|---|---|---|---|---|---|---|---|
| 34 | P F C | F L S | V T A | L L G | N S L | 23 | 8755 |
| 61 | E P M | Y Y F | L S M | L S A | T D L | 22 | 8756 |
| 15 | I F L | L T G | V P G | L E A | F H T | 20 | 8757 |
| 11 | S T S | I I F | L L T | G V P | G L E | 19 | 8758 |
| 12 | T S I | I F L | L T G | V P G | L E A | 19 | 8759 |
| 27 | F H T | W I S | I P F | C F L | S V T | 16 | 8760 |
| 32 | S I P | F C F | L S V | T A L | L G N | 16 | 8761 |
| 48 | L I L | F A T | I T Q | P S L | H E P | 16 | 8762 |
| 37 | F L S | V T A | L L G | N S L | I L F | 14 | 8763 |
| 51 | F A T | I T Q | P S L | H E P | M Y Y | 14 | 8764 |
| 21 | V P G | L E A | F H T | W I S | I P F | 13 | 8765 |
| 28 | H T W | I S I | P F C | F L S | V T A | 13 | 8766 |
| 47 | S L I | L F A | T I T | Q P S | L H E | 13 | 8767 |
| 57 | P S L | H E P | M Y Y | F L S | M L S | 13 | 8768 |
| 60 | H E P | M Y Y | F L S | M L S | A T D | 13 | 8769 |
| 3 | T S T | L Q N | I T S | T S I | I F L | 12 | 8770 |
| 9 | I T S | T S I | T F L | L T G | V P G | 12 | 8771 |
| 18 | L T G | V P C | L E A | F H T | W I S | 12 | 8772 |
| 41 | T A L | L G N | S L I | L F A | T I T | 12 | 8773 |
| 46 | N S L | I L F | A T I | T Q P | S L H | 12 | 8774 |
| 62 | P M Y | Y F L | S M L | S A T | D L G | 11 | 8775 |
| 13 | S I T | F L L | T G V | P G L | E A F | 10 | 8776 |
| 24 | L E A | F H T | W I S | T P F | C F L | 10 | 8777 |
| 8 | N I T | S T S | I I F | L L T | G V P | 9 | 8778 |
| 14 | I I F | L L T | G V P | G L E | A F H | 9 | 8779 |
| 6 | L Q N | I T S | T S I | I F L | L T G | 8 | 8780 |
| 20 | G V P | G L E | A F H | T W I | S I P | 8 | 8781 |
| 23 | C L E | A F H | T W I | S I P | F C F | 8 | 8782 |
| 25 | E A F | H T W | I S I | P F C | F L S | 8 | 8783 |
| 52 | A T I | T Q P | S L H | E P M | Y Y F | 8 | 8784 |
| 30 | W I S | I P F | C F L | S V T | A L L | 7 | 8785 |
| 31 | I S I | P F C | F L S | V T A | L L G | 7 | 8786 |
| 35 | F G F | L S V | T A L | L G N | S L I | 7 | 8787 |
| 38 | L S V | T A L | L G N | S L I | L F A | 7 | 8788 |
| 40 | V T A | L L G | N S L | I L F | A T I | 7 | 8789 |
| 44 | L G N | S L I | L F A | T I T | Q P S | 7 | 8790 |
| 2 | I T S | T L Q | N I T | S T S | I I F | 6 | 8791 |
| 36 | C F L | S V T | A L L | G N S | L I L | 6 | 8792 |
| 42 | A L L | G N S | L I L | F A T | I T Q | 6 | 8793 |
| 43 | L L G | N S L | I L F | A T I | T Q P | 6 | 8794 |
| 45 | G N S | L I L | F A T | I T Q | P S L | 6 | 8795 |
| 53 | T I T | Q P S | L H E | P M Y | Y F L | 6 | 8796 |
| 56 | Q P S | L H E | P M Y | Y F L | S M L | 6 | 8797 |
| 33 | I P F | C F L | S V T | A L L | G N S | 4 | 8798 |
| 49 | I L F | A T I | T Q P | S L H | E P M | 3 | 8799 |
| 1 | F I T | S T L | Q N I | T S T | S I I | 2 | 8800 |
| 4 | S T L | Q N I | T S T | S I I | F L L | 1 | 8801 |
| 5 | T L Q | N I T | S T S | I I F | L L T | 1 | 8802 |
| 7 | Q N I | T S T | S I I | F L L | T G V | 1 | 8803 |
| 16 | F L L | T G V | P G L | E A F | H T W | | 8804 |

TABLE XIXC part 3

| Pos | 1 2 3 | 4 5 6 | 7 8 9 | 0 1 2 | 3 4 5 | score | SEQ ID |
|---|---|---|---|---|---|---|---|

HLA-DRB1*0101 15-mers, v.2: 238P1B2

| Pos | 1 2 3 | 4 5 6 | 7 8 9 | 0 1 2 | 3 4 5 | score | SEQ ID |
|---|---|---|---|---|---|---|---|
| 7 | M I A | N T Y | L L T | S P L | M N P | 23 | 8805 |
| 8 | I A N | T Y L | L T S | P L M | N P V | 23 | 8806 |
| 1 | P A Y | V H T | M I A | N T Y | L L T | 22 | 8807 |
| 2 | A Y V | H T M | T A N | T Y L | L T S | 17 | 8808 |
| 3 | Y V H | T M I | A N T | Y L L | T S P | 17 | 8809 |
| 9 | A N T | Y L L | T S P | L M N | P V I | 17 | 8810 |
| 11 | T Y L | L T S | P L M | N P V | I Y S | 17 | 8811 |
| 5 | H T M | I A N | T Y L | L T S | P L M | 16 | 8812 |
| 10 | N T Y | L L T | S P L | M N P | V I Y | 16 | 8813 |
| 12 | Y L L | T S P | L M N | P V I | Y S V | 16 | 8814 |
| 15 | T S P | L M N | P V I | Y S V | K T K | 16 | 8815 |
| 13 | L L T | S P L | M N P | V I Y | S V K | 13 | 8816 |
| 6 | T M I | A N T | Y L L | T S P | L M N | 10 | 8817 |
| 14 | L T S | P L M | N P V | I Y S | V K T | 9 | 8818 |
| 4 | V H T | M I A | N T Y | L L T | S P L | 8 | 8819 |

TABLE XIXC-continued part 3

| Pos | 1 2 3 | 4 5 6 | 7 8 9 | 0 1 2 | 3 4 5 | score | SEQ ID |
|---|---|---|---|---|---|---|---|
| HLA-DRB1*0301 (DR17) 15-mers, v.2: 238P1B2 | | | | | | | |
| 1 | P A Y | V H T | M I A | N T Y | L L T | 19 | 8820 |
| 2 | A Y V | H T M | I A N | T Y L | L T S | 16 | 8821 |
| 10 | N T Y | L L T | S P L | M N P | V I Y | 14 | 8822 |
| 11 | T Y L | L T S | P L M | N P V | I Y S | 14 | 8823 |
| 4 | V H T | M I A | N T Y | L L T | S P L | 13 | 8824 |
| 5 | H T M | I A N | T Y L | L T S | P L M | 11 | 8825 |
| 7 | M I A | N T Y | L L T | S P L | M N P | 10 | 8826 |
| 13 | L L T | S P L | M N P | V I Y | S V K | 10 | 8827 |
| 15 | T S P | L M N | P V I | Y S V | K T K | 10 | 8828 |
| 3 | Y V H | T M I | A N T | Y L L | T S P | 9 | 8829 |
| 12 | Y L L | T S P | L M N | P V I | Y S V | 7 | 8830 |
| 9 | A N T | Y L L | T S P | L M N | P V I | 5 | 8831 |
| 14 | L T S | P L M | N P V | I Y S | V K T | 4 | 8832 |
| 8 | I A N | T Y L | L T S | P L M | N P V | 2 | 8833 |
| 6 | T M I | A N T | Y L L | T S P | L M N | 1 | 8834 |
| HLA-DRB1*0401 (DR4Dw4) 15-mers, v.2: 238P1B2 | | | | | | | |
| 2 | A Y V | H T M | I A N | T Y L | L T S | 18 | 8835 |
| 3 | Y V H | T M I | A N T | Y L L | T S P | 18 | 8836 |
| 7 | M I A | N T Y | L L T | S P L | M N P | 18 | 8837 |
| 8 | I A N | T Y L | L T S | P L M | N P V | 18 | 8838 |
| 12 | Y L L | T S P | L M N | P V I | Y S V | 18 | 8839 |
| 9 | A N T | Y L L | T S P | L M N | P V I | 16 | 8840 |
| 4 | V H T | M I A | N T Y | L L T | S P L | 14 | 8841 |
| 5 | H T M | I A N | T Y L | L T S | P L M | 14 | 8842 |
| 11 | T Y L | L T S | P L M | N P V | I Y S | 14 | 8843 |
| 15 | T S P | L M N | P V I | Y S V | K T K | 14 | 8844 |
| 1 | P A Y | V H T | M I A | N T Y | L L T | 8 | 8845 |
| 10 | N T Y | L L T | S P L | M N P | V I Y | 8 | 8846 |
| 14 | L T S | P L M | N P V | I Y S | V K T | 6 | 8847 |
| HLA-DRB1*1101 15-mers, v.2: 238P1B2 | | | | | | | |
| 1 | P A Y | V H T | M I A | N T Y | L L T | 12 | 8848 |
| 5 | H T M | I A N | T Y L | L T S | P L M | 12 | 8849 |
| 10 | N T Y | L L T | S P L | M N P | V I Y | 12 | 8850 |
| 9 | A N T | Y L L | T S P | L M N | P V I | 10 | 8851 |
| 2 | A Y V | H T M | I A N | T Y L | L T S | 8 | 8852 |
| 7 | M I A | N T Y | L L T | S P L | M N P | 8 | 8853 |
| 11 | T Y L | L T S | P L M | N P V | I Y S | 8 | 8854 |
| 15 | T S P | L M N | P V I | Y S V | K T K | 8 | 8855 |
| 4 | V H T | M I A | N T Y | L L T | S P L | 7 | 8856 |
| 8 | I A N | T Y L | L T S | P L M | N P V | 7 | 8857 |
| 12 | Y L L | T S P | L M N | P V I | Y S V | 7 | 8858 |
| 13 | L L T | S P L | M N P | V I Y | S V K | 7 | 8859 |
| 6 | T M I | A N T | Y L L | T S P | L M N | 6 | 8860 |
| 14 | L T S | P L M | N P V | I Y S | V K T | | 8861 |

TABLE XX

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| rvt | 49% | Reverse transcriptase (RNA-dependent DNA polymerase) | |
| ank | 25% | Ank repeat | Cytoplasmic protein, associates integral membrane proteins to the cytoskeleton |
| oxidored_q1 | 32% | NADH-Ubiquinone/plastoquinone (complex I), various chains | membrane associated. Involved in proton translocation across the membrane |
| efhand | 24% | EF hand | calcium-binding domain, consists of a12 residue loop flanked on both sides by a 12 residue alpha-helical domain |
| rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |

TABLE XX-continued

Frequently Occurring Motifs

| Name | avrg. % identity | Description | Potential Function |
|---|---|---|---|
| fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE XXI

Motifs and Post-translational Modifications of 238P1B2 cAMP- and cGMP-dependent protein kinase phosphorylation site.

| | |
|---|---|
| 176-179 | RKeT (SEQ ID: 8862) |

Protein kinase C phosphorylation site.

| | |
|---|---|
| 235-237 | SvK |

Casein kinase II phosphorylation site.

| | |
|---|---|
| 9-12 | SatD (SEQ ID: 8863) |
| 50-53 | TvmE (SEQ ID: 8864) |
| 130-133 | SctD (SEQ ID: 8865) |
| 172-175 | SpeE (SEQ ID: 8866) |

N-myristoylation site.

| | |
|---|---|
| 14-19 | GLsiST (SEQ ID: 8867) |

G-protein coupled receptors family 1 signature.

| | |
|---|---|
| 52-68 | MESsvLlaMAFDRFvaV (SEQ ID: 8868) |

G-protein coupled receptors family 1

| | |
|---|---|
| 1-234 | |

TABLE XXII

Physical Features of 238P1B2

| | Bioinformatic Program | Outcome |
|---|---|---|
| 238P1B2 Variant 1A | | |
| ORF | ORF finder | 3758 bp |
| Protein length | | 254 aa |
| Transmembrane region | TM Pred | N terminus intracellular, 6 TM TM helices at 3-29, 44-62, 86-110, 144-161, 182-203, 217-236aa |
| | HMMTop | N terminus intracellular, 6TM TM helices at 6-28, 43-62, 86-105, 136-158, 180-203, 216-235aa |
| | Sosui | Membrane protein, 6TM TM helices at 6-28, 42-64, 87-109, 144-166, 187-209, 217-237aa |
| | TMHMM | N terminus intracellular, 6TM TM helices at 7-29, 44-66, 86-108, 142-164, 185-207, 212-234aa |
| Signal Peptide | Signal P | cleavage site between 169-170aa |
| pI | pI/MW tool | pI 9.24 |
| Molecular weight | pI/MW tool | 28.59 kDa |
| Localization | PSORT | 60% plasma membrane, 42.9% mitochondrial inner membrane, 40% Golgi, 30% endoplasmic reticulum membrane |
| | PSORT II | 44.4% endoplasmic reticulum, 22.2% plasma membrane |
| Motifs | Pfam | 7TM receptor (rhodopsin family) |
| | Prints | Olfactory receptor signature, Type III secretion system inner membrane R protein, fibronectin Type III repeat signature |
| | Blocks | no significant motif |
| 238P1B2 Variant 1B | | |
| ORF | ORF finder | 3758 bp |
| Protein length | | 316 aa |

TABLE XXII-continued

Physical Features of 238P1B2

| | Bioinformatic Program | Outcome |
|---|---|---|
| Transmembrane region | TM Pred | N terminus extracellular, 8 TM<br>TM helices at 9-27, 33-51, 75-91, 98-125, 145-171, 206-226, 249-265, 276-296aa |
| | HMMTop | N terminus extracellular, 7TM<br>TM helices at 29-53, 66-90, 105-124, 148-171, 202-226, 241-265, 278-297aa |
| | Sosui | Membrane protein, 8TM<br>TM helices at 2-24, 33-55, 67-89, 104-126, 149-171, 206-228, 245-267, 279-299aa |
| | TMHMM | N terminus intracellular, 7TM<br>TM helices at 30-52, 65-87, 102-124, 145-167, 204-226, 247-269, 274-296aa |
| Signal Peptide | Signal P | cleavage site between aa 26 and 27 |
| pI | pI/MW tool | pI 9.03 |
| Molecular weight | pI/MW tool | 35.34 kDa |
| Localization | PSORT | 64% plasma membrane, 46% Golgi, 37% endoplasmic reticulum membrane |
| | PSORT II | 44.4% endoplasmic reticulum, 33.3% plasma membrane |
| Motifs | Pfam | 7TM receptor (rhodopsin family), polysaccharide biosynthesis protein |
| | Prints | Olfactory receptor signature, Type III secretion system inner membrane R protein, fibronectin Type III repeat signature |
| | Blocks | no significant motif |

TABLE XXIII

Exon compositions of 238P1B2 v.1

| Exon Number | Start | End |
|---|---|---|
| Exon 1 | 1 | 3758 |

SEQUENCE LISTING (8913 sequences)

SEQ ID NO: 1 - protein, 14 aa, Clostridium tetani
QYIKANSKFIGITE

SEQ ID NO: 2 - protein, 21 aa, Plasmodium falciparum
DIEKKIAKMEKASSVFNVVNS

SEQ ID NO: 3 - protein, 16 aa, Streptococcu Aureus
GAVDSILGGVATYGAA

SEQ ID NO: 4 - protein, 13 aa, Artificial Sequence
  Artificially Synthesized Peptide
  VARIANT 3: Xaa = cyclohexylalanine, phenylalanine, or tyrosine
  VARIANT 1, 13: Xaa = D-alanine or L-alanine
XKXVAAWTLKAAX

SEQ ID NO: 5 - protein, 4 aa, Artificial Sequence
  Artificially Synthesized Peptide
KDEL

SEQ ID NO: 6 - DNA, 43 bp, Artificial Sequence
  Artificially Synthesized Primer
ttttgatcaagcttttttttttttttttttttttttttttttt

SEQ ID NO: 7 - DNA, 42 bp, Artificial Sequence
  Artificially Synthesized Primer
ctaatacgactcactatagggctcgagcggccgcccgggcag

SEQ ID NO: 8 - DNA, 12 bp, Artificial Sequence
  Artificially Synthesized Primer
ggcccgtcctag

SEQ ID NO: 9 - DNA, 40 bp, Artificial Sequence
  Artificially Synthesized Primer
gtaatacgactcactatagggcagcgtggtcgcggccgag

SEQ ID NO: 10 - DNA, 10 bp, Artificial Sequence
  Artificially Synthesized Primer
cggctcctag

SEQ ID NO: 11 - DNA, 22 bp, Artificial Sequence
  Artificially Synthesized Primer
ctaatacgactcactatagggc

SEQ ID NO: 12 - DNA, 22 bp, Artificial Sequence
  Artificially Synthesized Primer
tcgagcggccgcccgggcagga

SEQ ID NO: 13 - DNA, 20 bp, Artificial Sequence
  Artificially Synthesized Primer
agcgtggtcgcggccgagga

SEQ ID NO: 14 - DNA, 25 bp, Artificial Sequence
  Artificially Synthesized Primer
atatcgccgcgctcgtcgtcgacaa

SEQ ID NO: 15 - DNA, 26 bp, Artificial Sequence
  Artificially Synthesized Primer
agccacacgcagctcattgtagaagg

SEQ ID NO: 16 - DNA, 24 bp, Artificial Sequence
  Artificially Synthesized Primer
ttgcagaatatcacctccacttcc

SEQ ID NO: 17 - DNA, 23 bp, Artificial Sequence
  Artificially Synthesized Primer
gatcaggctgtttcccaagagag

SEQ ID NO: 18 - DNA, 24 bp, Artificial Sequence
  Artificially Synthesized Primer
gattacaaggatgacgacgataag

SEQ ID NO: 19 - protein, 9 aa, Homo Sapiens
DLLLILLSY

SEQ ID NO: 20 - protein, 9 aa, Homo Sapiens
VAVSNPLRY

SEQ ID NO: 21 - protein, 9 aa, Homo Sapiens
GVDLLLILL

SEQ ID NO: 22 - protein, 9 aa, Homo Sapiens
LTDSRIAQI

SEQ ID NO: 23 - protein, 9 aa, Homo Sapiens
VALLIRLSY

SEQ ID NO: 24 - protein, 9 aa, Homo Sapiens
HIVAFAIYY

SEQ ID NO: 25 - protein, 9 aa, Homo Sapiens
SPEERKETF

SEQ ID NO: 26 - protein, 9 aa, Homo Sapiens
VMESSVLLA

SEQ ID NO: 27 - protein, 9 aa, Homo Sapiens
LSIVHRFGK

SEQ ID NO: 28 - protein, 9 aa, Homo Sapiens
ATDLGLSIS

SEQ ID NO: 29 - protein, 9 aa, Homo Sapiens
VTMLSIFWF

SEQ ID NO: 30 - protein, 9 aa, Homo Sapiens
CTDTRINSA

SEQ ID NO: 31 - protein, 9 aa, Homo Sapiens
CLSHMFFIK

SEQ ID NO: 32 - protein, 9 aa, Homo Sapiens
QVLHHSYCY

SEQ ID NO: 33 - protein, 9 aa, Homo Sapiens
LSHMFFIKF

SEQ ID NO: 34 - protein, 9 aa, Homo Sapiens
HSQVLHHSY

SEQ ID NO: 35 - protein, 9 aa, Homo Sapiens
SSVLLAMAF

SEQ ID NO: 36 - protein, 9 aa, Homo Sapiens
HPDVMKLSC

SEQ ID NO: 37 - protein, 9 aa, Homo Sapiens
NACLSHMFF

SEQ ID NO: 38 - protein, 9 aa, Homo Sapiens
VLLAMAFDR

SEQ ID NO: 39 - protein, 9 aa, Homo Sapiens
LLSYVLIIR

SEQ ID NO: 40 - protein, 9 aa, Homo Sapiens
YCYHPDVMK

SEQ ID NO: 41 - protein, 9 aa, Homo Sapiens
VSNPLRYAM

SEQ ID NO: 42 - protein, 9 aa, Homo Sapiens
SPLMNPVIY

SEQ ID NO: 43 - protein, 9 aa, Homo Sapiens
FVAVSNPLR

SEQ ID NO: 44 - protein, 9 aa, Homo Sapiens
QIGVASVIR

SEQ ID NO: 45 - protein, 9 aa, Homo Sapiens
LISLSIVHR

SEQ ID NO: 46 - protein, 9 aa, Homo Sapiens
MLTPMVALL

SEQ ID NO: 47 - protein, 9 aa, Homo Sapiens
SAVGLTAMF

SEQ ID NO: 48 - protein, 9 aa, Homo Sapiens
TCVSHIVAF

SEQ ID NO: 49 - protein, 9 aa, Homo Sapiens
SVASPEERK

SEQ ID NO: 50 - protein, 9 aa, Homo Sapiens
LSVASPEER

SEQ ID NO: 51 - protein, 9 aa, Homo Sapiens
ISLSIVHRF

SEQ ID NO: 52 - protein, 9 aa, Homo Sapiens
LSIFWFNVR

SEQ ID NO: 53 - protein, 9 aa, Homo Sapiens
STLVTMLSI

SEQ ID NO: 54 - protein, 9 aa, Homo Sapiens
TPMVALLIR

SEQ ID NO: 55 - protein, 9 aa, Homo Sapiens
LTPMVALLI

SEQ ID NO: 56 - protein, 9 aa, Homo Sapiens
STCVSHIVA

SEQ ID NO: 57 - protein, 9 aa, Homo Sapiens
STVGVDLLL

SEQ ID NO: 58 - protein, 9 aa, Homo Sapiens
LISPLMNPV

SEQ ID NO: 59 - protein, 9 aa, Homo Sapiens
TLVTMLSIF

SEQ ID NO: 60 - protein, 9 aa, Homo Sapiens
LLAMAFDRF

SEQ ID NO: 61 - protein, 9 aa, Homo Sapiens
YAMILTDSR

SEQ ID NO: 62 - protein, 9 aa, Homo Sapiens
LMNPVIYSV

SEQ ID NO: 63 - protein, 9 aa, Homo Sapiens
LSYVLIIRT

SEQ ID NO: 64 - protein, 9 aa, Homo Sapiens
ASVIRGLLM

SEQ ID NO: 65 - protein, 9 aa, Homo Sapiens
VSHIVAFAI

SEQ ID NO: 66 - protein, 9 aa, Homo Sapiens
ISTLVTMLS

SEQ ID NO: 67 - protein, 9 aa, Homo Sapiens
ISFNACLSH

SEQ ID NO: 68 - protein, 9 aa, Homo Sapiens
ILTDSRIAQ

SEQ ID NO: 69 - protein, 9 aa, Homo Sapiens
SATDLGLSI

SEQ ID NO: 70 - protein, 9 aa, Homo Sapiens
MIANTYLLI

SEQ ID NO: 71 - protein, 9 aa, Homo Sapiens
YCHSQVLHH

SEQ ID NO: 72 - protein, 9 aa, Homo Sapiens
SHIVAFAIY

SEQ ID NO: 73 - protein, 9 aa, Homo Sapiens
AIYYIPLIS

SEQ ID NO: 74 - protein, 9 aa, Homo Sapiens
SVKTKQIRR

SEQ ID NO: 75 - protein, 9 aa, Homo Sapiens
YLLISPLMN

SEQ ID NO: 76 - protein, 9 aa, Homo Sapiens
SCTDTRINS

SEQ ID NO: 77 - protein, 9 aa, Homo Sapiens
LVTMLSIFW

SEQ ID NO: 78 - protein, 9 aa, Homo Sapiens
GLSISTLVT

SEQ ID NO: 79 - protein, 9 aa, Homo Sapiens
ACLSHMFFI

SEQ ID NO: 80 - protein, 9 aa, Homo Sapiens
MLSIFWFNV

SEQ ID NO: 81 - protein, 9 aa, Homo Sapiens
YIPLISLSI

SEQ ID NO: 82 - protein, 9 aa, Homo Sapiens
MLSATDLGL

SEQ ID NO: 83 - protein, 9 aa, Homo Sapiens
LLMLTPMVA

SEQ ID NO: 84 - protein, 9 aa, Homo Sapiens
TVGVDLLLI

SEQ ID NO: 85 - protein, 9 aa, Homo Sapiens
MNPVIYSVK

SEQ ID NO: 86 - protein, 9 aa, Homo Sapiens
ILLSYVLII

SEQ ID NO: 87 - protein, 9 aa, Homo Sapiens
AVGLTAMFS

SEQ ID NO: 88 - protein, 9 aa, Homo Sapiens
IANTYLLIS

SEQ ID NO: 89 - protein, 9 aa, Homo Sapiens
RAVIKILHS

SEQ ID NO: 90 - protein, 9 aa, Homo Sapiens
ETFSTCVSH

SEQ ID NO: 91 - protein, 9 aa, Homo Sapiens
RKETFSTCV

SEQ ID NO: 92 - protein, 9 aa, Homo Sapiens
VREISFNAC

SEQ ID NO: 93 - protein, 9 aa, Homo Sapiens
LSISTLVTM

SEQ ID NO: 94 - protein, 9 aa, Homo Sapiens
KQAPAYVHT

SEQ ID NO: 95 - protein, 9 aa, Homo Sapiens
ESSVLLAMA

SEQ ID NO: 96 - protein, 9 aa, Homo Sapiens
ISPLMNPVI

SEQ ID NO: 97 - protein, 9 aa, Homo Sapiens
HSYCYHPDV

SEQ ID NO: 98 - protein, 9 aa, Homo Sapiens
HTMIANTYL

SEQ ID NO: 99 - protein, 9 aa, Homo Sapiens
LTAMFSTVG

SEQ ID NO: 100 - protein, 9 aa, Homo Sapiens
FTVMESSVL

SEQ ID NO: 101 - protein, 9 aa, Homo Sapiens
NTYLLISPL

SEQ ID NO: 102 - protein, 9 aa, Homo Sapiens
HMFFIKFFT

SEQ ID NO: 103 - protein, 9 aa, Homo Sapiens
WFNVREISF

SEQ ID NO: 104 - protein, 9 aa, Homo Sapiens
AMAFDRFVA

SEQ ID NO: 105 - protein, 9 aa, Homo Sapiens
VHTMIANTY

SEQ ID NO: 106 - protein, 9 aa, Homo Sapiens
FNACLSHMF

SEQ ID NO: 107 - protein, 9 aa, Homo Sapiens
CYHPDVMKL

SEQ ID NO: 108 - protein, 9 aa, Homo Sapiens
YVHTMIANT

SEQ ID NO: 109 - protein, 9 aa, Homo Sapiens
TAMFSTVGV

SEQ ID NO: 110 - protein, 9 aa, Homo Sapiens
TVMESSVLL

SEQ ID NO: 111 - protein, 9 aa, Homo Sapiens
IAQIGVASV

SEQ ID NO: 112 - protein, 9 aa, Homo Sapiens
VLIIRTVLS

SEQ ID NO: 113 - protein, 9 aa, Homo Sapiens
PVIYSVKTK

SEQ ID NO: 114 - protein, 9 aa, Homo Sapiens
MAFDRFVAV

SEQ ID NO: 115 - protein, 9 aa, Homo Sapiens
CVSHIVAFA

SEQ ID NO: 116 - protein, 9 aa, Homo Sapiens
LLILLSYVL

SEQ ID NO: 117 - protein, 9 aa, Homo Sapiens
IVAFAIYYI

SEQ ID NO: 118 - protein, 9 aa, Homo Sapiens
AVIKILHSK

SEQ ID NO: 119 - protein, 9 aa, Homo Sapiens
GLEAFHTWI

SEQ ID NO: 120 - protein, 9 aa, Homo Sapiens
LHEPMYYFL

SEQ ID NO: 121 - protein, 9 aa, Homo Sapiens
ISIPFCFLS

SEQ ID NO: 122 - protein, 9 aa, Homo Sapiens
NITSTSIIF

SEQ ID NO: 123 - protein, 9 aa, Homo Sapiens
LLGNSLILF

SEQ ID NO: 124 - protein, 9 aa, Homo Sapiens
PSLHEPMYY

SEQ ID NO: 125 - protein, 9 aa, Homo Sapiens
QPSLHEPMY

SEQ ID NO: 126 - protein, 9 aa, Homo Sapiens
TGVPGLEAF

SEQ ID NO: 127 - protein, 9 aa, Homo Sapiens
SLHEPMYYF

SEQ ID NO: 128 - protein, 9 aa, Homo Sapiens
ITSTSIIFL

SEQ ID NO: 129 - protein, 9 aa, Homo Sapiens
LTGVPGLEA

SEQ ID NO: 130 - protein, 9 aa, Homo Sapiens
STSIIFLLT

SEQ ID NO: 131 - protein, 9 aa, Homo Sapiens
TSTLQNITS

SEQ ID NO: 132 - protein, 9 aa, Homo Sapiens
TSTSIIFLL

SEQ ID NO: 133 - protein, 9 aa, Homo Sapiens
LSVTALLGN

SEQ ID NO: 134 - protein, 9 aa, Homo Sapiens
TSIIFLLTG

SEQ ID NO: 135 - protein, 9 aa, Homo Sapiens
FLSVTALLG

SEQ ID NO: 136 - protein, 9 aa, Homo Sapiens
SIPFCFLSV

SEQ ID NO: 137 - protein, 9 aa, Homo Sapiens
EAFHTWISI

SEQ ID NO: 138 - protein, 9 aa, Homo Sapiens
LILFATITQ

SEQ ID NO: 139 - protein, 9 aa, Homo Sapiens
ALLGNSLIL

SEQ ID NO: 140 - protein, 9 aa, Homo Sapiens
NSLILFATI

SEQ ID NO: 141 - protein, 9 aa, Homo Sapiens
FHTWISIPF

SEQ ID NO: 142 - protein, 9 aa, Homo Sapiens
STLQNITST

SEQ ID NO: 143 - protein, 9 aa, Homo Sapiens
ITQPSLHEP

SEQ ID NO: 144 - protein, 9 aa, Homo Sapiens
VTALLGNSL

SEQ ID NO: 145 - protein, 9 aa, Homo Sapiens
ITSTLQNIT

SEQ ID NO: 146 - protein, 9 aa, Homo Sapiens
ATITQPSLH

SEQ ID NO: 147 - protein, 9 aa, Homo Sapiens
TWISIPFCF

SEQ ID NO: 148 - protein, 9 aa, Homo Sapiens
GVPGLEAFH

SEQ ID NO: 149 - protein, 9 aa, Homo Sapiens
FATITQPSL

SEQ ID NO: 150 - protein, 9 aa, Homo Sapiens
FLLTGVPGL

SEQ ID NO: 151 - protein, 9 aa, Homo Sapiens
EPMYYFLSM

SEQ ID NO: 152 - protein, 9 aa, Homo Sapiens
VPGLEAFHT

SEQ ID NO: 153 - protein, 9 aa, Homo Sapiens
GNSLILFAT

SEQ ID NO: 154 - protein, 9 aa, Homo Sapiens
LGNSLILFA

SEQ ID NO: 155 - protein, 9 aa, Homo Sapiens
SIIFLLTGV

SEQ ID NO: 156 - protein, 9 aa, Homo Sapiens
FITSTLQNI

SEQ ID NO: 157 - protein, 9 aa, Homo Sapiens
FCFLSVTAL

SEQ ID NO: 158 - protein, 9 aa, Homo Sapiens
SLILFATIT

SEQ ID NO: 159 - protein, 9 aa, Homo Sapiens
TALLGNSLI

SEQ ID NO: 160 - protein, 9 aa, Homo Sapiens
SVTALLGNS

SEQ ID NO: 161 - protein, 9 aa, Homo Sapiens
WISIPFCFL

SEQ ID NO: 162 - protein, 9 aa, Homo Sapiens
TLQNITSTS

SEQ ID NO: 163 - protein, 9 aa, Homo Sapiens
TITQPSLHE

SEQ ID NO: 164 - protein, 9 aa, Homo Sapiens
HTWISIPFC

SEQ ID NO: 165 - protein, 9 aa, Homo Sapiens
HEPMYYFLS

SEQ ID NO: 166 - protein, 9 aa, Homo Sapiens
IPFCFLSVT

SEQ ID NO: 167 - protein, 9 aa, Homo Sapiens
QNITSTSII

SEQ ID NO: 168 - protein, 9 aa, Homo Sapiens
TQPSLHEPM

SEQ ID NO: 169 - protein, 9 aa, Homo Sapiens
LQNITSTSI

SEQ ID NO: 170 - protein, 9 aa, Homo Sapiens
IIFLLTGVP

SEQ ID NO: 171 - protein, 9 aa, Homo Sapiens
CFLSVTALL

SEQ ID NO: 172 - protein, 9 aa, Homo Sapiens
ILFATITQP

SEQ ID NO: 173 - protein, 9 aa, Homo Sapiens
IFLLTGVPG

SEQ ID NO: 174 - protein, 9 aa, Homo Sapiens
LLTGVPGLE

SEQ ID NO: 175 - protein, 9 aa, Homo Sapiens
LFATITQPS

SEQ ID NO: 176 - protein, 9 aa, Homo Sapiens
PMYYFLSML

SEQ ID NO: 177 - protein, 9 aa, Homo Sapiens
LEAFHTWIS

SEQ ID NO: 178 - protein, 9 aa, Homo Sapiens
PGLEAFHTW

SEQ ID NO: 179 - protein, 9 aa, Homo Sapiens
PFCFLSVTA

SEQ ID NO: 180 - protein, 9 aa, Homo Sapiens
AFHTWISIP

SEQ ID NO: 181 - protein, 9 aa, Homo Sapiens
LTSPLMNPV

SEQ ID NO: 182 - protein, 9 aa, Homo Sapiens
MIANTYLLT

SEQ ID NO: 183 - protein, 9 aa, Homo Sapiens
IANTYLLTS

SEQ ID NO: 184 - protein, 9 aa, Homo Sapiens
YLLTSPLMN

SEQ ID NO: 185 - protein, 9 aa, Homo Sapiens
TSPLMNPVI

SEQ ID NO: 186 - protein, 9 aa, Homo Sapiens
NTYLLTSPL

SEQ ID NO: 187 - protein, 9 aa, Homo Sapiens
LLTSPLMNP

SEQ ID NO: 188 - protein, 9 aa, Homo Sapiens
TYLLTSPLM

SEQ ID NO: 189 - protein, 9 aa, Homo Sapiens
ANTYLLTSP

SEQ ID NO: 190 - protein, 10 aa, Homo Sapiens
ATDLGLSIST

SEQ ID NO: 191 - protein, 10 aa, Homo Sapiens
GVDLLLILLS

SEQ ID NO: 192 - protein, 10 aa, Homo Sapiens
FVAVSNPLRY

SEQ ID NO: 193 - protein, 10 aa, Homo Sapiens
MVALLIRLSY

SEQ ID NO: 194 - protein, 10 aa, Homo Sapiens
VMESSVLLAM

SEQ ID NO: 195 - protein, 10 aa, Homo Sapiens
ISPLMNPVIY

SEQ ID NO: 196 - protein, 10 aa, Homo Sapiens
VSHIVAFAIY

SEQ ID NO: 197 - protein, 10 aa, Homo Sapiens
LTDSRIAQIG

SEQ ID NO: 198 - protein, 10 aa, Homo Sapiens
LTPMVALLIR

SEQ ID NO: 199 - protein, 10 aa, Homo Sapiens
CTDTRINSAV

SEQ ID NO: 200 - protein, 10 aa, Homo Sapiens
ACLSHMFFIK

SEQ ID NO: 201 - protein, 10 aa, Homo Sapiens
LMNPVIYSVK

SEQ ID NO: 202 - protein, 10 aa, Homo Sapiens
SLSIVHRFGK

SEQ ID NO: 203 - protein, 10 aa, Homo Sapiens
ESSVLLAMAF

SEQ ID NO: 204 - protein, 10 aa, Homo Sapiens
CLSHMFFIKF

SEQ ID NO: 205 - protein, 10 aa, Homo Sapiens
SVLLAMAFDR

SEQ ID NO: 206 - protein, 10 aa, Homo Sapiens
ILLSYVLIIR

SEQ ID NO: 207 - protein, 10 aa, Homo Sapiens
LVTMLSIFWF

SEQ ID NO: 208 - protein, 10 aa, Homo Sapiens
YVHTMIANTY

SEQ ID NO: 209 - protein, 10 aa, Homo Sapiens
MLTPMVALLI

SEQ ID NO: 210 - protein, 10 aa, Homo Sapiens
STCVSHIVAF

SEQ ID NO: 211 - protein, 10 aa, Homo Sapiens
VSNPLRYAMI

SEQ ID NO: 212 - protein, 10 aa, Homo Sapiens
LSVASPEERK

SEQ ID NO: 213 - protein, 10 aa, Homo Sapiens
NSAVGLTAMF

SEQ ID NO: 214 - protein, 10 aa, Homo Sapiens
STLVTMLSIF

SEQ ID NO: 215 - protein, 10 aa, Homo Sapiens
SPEERKETFS

SEQ ID NO: 216 - protein, 10 aa, Homo Sapiens
RAVIKILHSK

SEQ ID NO: 217 - protein, 10 aa, Homo Sapiens
LISPLMNPVI

SEQ ID NO: 218 - protein, 10 aa, Homo Sapiens
LSHMFFIKFF

SEQ ID NO: 219 - protein, 10 aa, Homo Sapiens
ASPEERKETF

SEQ ID NO: 220 - protein, 10 aa, Homo Sapiens
SQVLHHSYCY

SEQ ID NO: 221 - protein, 10 aa, Homo Sapiens
SHIVAFAIYY

SEQ ID NO: 222 - protein, 10 aa, Homo Sapiens
VDLLLILLSY

SEQ ID NO: 223 - protein, 10 aa, Homo Sapiens
FNACLSHMFF

SEQ ID NO: 224 - protein, 10 aa, Homo Sapiens
HPDVMKLSCT

SEQ ID NO: 225 - protein, 10 aa, Homo Sapiens
STVGVDLLLI

SEQ ID NO: 226 - protein, 10 aa, Homo Sapiens
VASPEERKET

SEQ ID NO: 227 - protein, 10 aa, Homo Sapiens
VLLAMAFDRF

SEQ ID NO: 228 - protein, 10 aa, Homo Sapiens
VLSVASPEER

SEQ ID NO: 229 - protein, 10 aa, Homo Sapiens
MLSIFWFNVR

SEQ ID NO: 230 - protein, 10 aa, Homo Sapiens
LISLSIVHRF

SEQ ID NO: 231 - protein, 10 aa, Homo Sapiens
VREISFNACL

SEQ ID NO: 232 - protein, 10 aa, Homo Sapiens
YSVKTKQIRR

SEQ ID NO: 233 - protein, 10 aa, Homo Sapiens
LSATDLGLSI

SEQ ID NO: 234 - protein, 10 aa, Homo Sapiens
FSTCVSHIVA

SEQ ID NO: 235 - protein, 10 aa, Homo Sapiens
FSTVGVDLLL

SEQ ID NO: 236 - protein, 10 aa, Homo Sapiens
ISTLVTMLSI

SEQ ID NO: 237 - protein, 10 aa, Homo Sapiens
LSCTDTRINS

SEQ ID NO: 238 - protein, 10 aa, Homo Sapiens
ASVIRGLLML

SEQ ID NO: 239 - protein, 10 aa, Homo Sapiens
HRFGKQAPAY

SEQ ID NO: 240 - protein, 10 aa, Homo Sapiens
GLLMLTPMVA

SEQ ID NO: 241 - protein, 10 aa, Homo Sapiens
QIGVASVIRG

SEQ ID NO: 242 - protein, 10 aa, Homo Sapiens
VASVIRGLLM

SEQ ID NO: 243 - protein, 10 aa, Homo Sapiens
NTYLLISPLM

SEQ ID NO: 244 - protein, 10 aa, Homo Sapiens
CVSHIVAFAI

SEQ ID NO: 245 - protein, 10 aa, Homo Sapiens
FAIYYIPLIS

SEQ ID NO: 246 - protein, 10 aa, Homo Sapiens
RINSAVGLTA

SEQ ID NO: 247 - protein, 10 aa, Homo Sapiens
MILTDSRIAQ

SEQ ID NO: 248 - protein, 10 aa, Homo Sapiens
NACLSHMFFI

SEQ ID NO: 249 - protein, 10 aa, Homo Sapiens
HTMIANTYLL

SEQ ID NO: 250 - protein, 10 aa, Homo Sapiens
MIANTYLLIS

SEQ ID NO: 251 - protein, 10 aa, Homo Sapiens
LILLSYVLII

SEQ ID NO: 252 - protein, 10 aa, Homo Sapiens
VAFAIYYIPL

SEQ ID NO: 253 - protein, 10 aa, Homo Sapiens
FTVMESSVLL

SEQ ID NO: 254 - protein, 10 aa, Homo Sapiens
TVGVDLLLIL

SEQ ID NO: 255 - protein, 10 aa, Homo Sapiens
TVMESSVLLA

SEQ ID NO: 256 - protein, 10 aa, Homo Sapiens
AIYYIPLISL

SEQ ID NO: 257 - protein, 10 aa, Homo Sapiens
SISTLVTMLS

SEQ ID NO: 258 - protein, 10 aa, Homo Sapiens
EISFNACLSH

SEQ ID NO: 259 - protein, 10 aa, Homo Sapiens
TLVTMLSIFW

SEQ ID NO: 260 - protein, 10 aa, Homo Sapiens
LTAMFSTVGV

SEQ ID NO: 261 - protein, 10 aa, Homo Sapiens
YCYHPDVMKL

SEQ ID NO: 262 - protein, 10 aa, Homo Sapiens
SAVGLTAMFS

SEQ ID NO: 263 - protein, 10 aa, Homo Sapiens
AVGLTAMFST

SEQ ID NO: 264 - protein, 10 aa, Homo Sapiens
NPVIYSVKTK

SEQ ID NO: 265 - protein, 10 aa, Homo Sapiens
VLIIRTVLSV

SEQ ID NO: 266 - protein, 10 aa, Homo Sapiens
LAMAFDRFVA

SEQ ID NO: 267 - protein, 10 aa, Homo Sapiens
LLSYVLIIRT

SEQ ID NO: 268 - protein, 10 aa, Homo Sapiens
RKETFSTCVS

SEQ ID NO: 269 - protein, 10 aa, Homo Sapiens
AQIGVASVIR

SEQ ID NO: 270 - protein, 10 aa, Homo Sapiens
LSYCHSQVLH

SEQ ID NO: 271 - protein, 10 aa, Homo Sapiens
ETFSTCVSHI

SEQ ID NO: 272 - protein, 10 aa, Homo Sapiens
SMLSATDLGL

SEQ ID NO: 273 - protein, 10 aa, Homo Sapiens
CHSQVLHHSY

SEQ ID NO: 274 - protein, 10 aa, Homo Sapiens
VTMLSIFWFN

SEQ ID NO: 275 - protein, 10 aa, Homo Sapiens
FWFNVREISF

SEQ ID NO: 276 - protein, 10 aa, Homo Sapiens
YYIPLISLSI

SEQ ID NO: 277 - protein, 10 aa, Homo Sapiens
HMFFIKFFTV

SEQ ID NO: 278 - protein, 10 aa, Homo Sapiens
TMIANTYLLI

SEQ ID NO: 279 - protein, 10 aa, Homo Sapiens
TMLSIFWFNV

SEQ ID NO: 280 - protein, 10 aa, Homo Sapiens
GLSISTLVTM

SEQ ID NO: 281 - protein, 10 aa, Homo Sapiens
SYCYHPDVMK

SEQ ID NO: 282 - protein, 10 aa, Homo Sapiens
ALLIRLSYCH

SEQ ID NO: 283 - protein, 10 aa, Homo Sapiens
TCVSHIVAFA

SEQ ID NO: 284 - protein, 10 aa, Homo Sapiens
MAFDRFVAVS

SEQ ID NO: 285 - protein, 10 aa, Homo Sapiens
LLLILLSYVL

SEQ ID NO: 286 - protein, 10 aa, Homo Sapiens
LLILLSYVLI

SEQ ID NO: 287 - protein, 10 aa, Homo Sapiens
YVLIIRTVLS

SEQ ID NO: 288 - protein, 10 aa, Homo Sapiens
RIAQIGVASV

SEQ ID NO: 289 - protein, 10 aa, Homo Sapiens
AVSNPLRYAM

SEQ ID NO: 290 - protein, 10 aa, Homo Sapiens
LHEPMYYFLS

SEQ ID NO: 291 - protein, 10 aa, Homo Sapiens
GLEAFHTWIS

SEQ ID NO: 292 - protein, 10 aa, Homo Sapiens
ISIPFCFLSV

SEQ ID NO: 293 - protein, 10 aa, Homo Sapiens
QPSLHEPMYY

SEQ ID NO: 294 - protein, 10 aa, Homo Sapiens
ALLGNSLILF

SEQ ID NO: 295 - protein, 10 aa, Homo Sapiens
ITQPSLHEPM

SEQ ID NO: 296 - protein, 10 aa, Homo Sapiens
LTGVPGLEAF

SEQ ID NO: 297 - protein, 10 aa, Homo Sapiens
TQPSLHEPMY

SEQ ID NO: 298 - protein, 10 aa, Homo Sapiens
ITSTLQNITS

SEQ ID NO: 299 - protein, 10 aa, Homo Sapiens
QNITSTSIIF

SEQ ID NO: 300 - protein, 10 aa, Homo Sapiens
HTWISIPFCF

SEQ ID NO: 301 - protein, 10 aa, Homo Sapiens
ITSTSIIFLL

SEQ ID NO: 302 - protein, 10 aa, Homo Sapiens
STSIIFLLTG

SEQ ID NO: 303 - protein, 10 aa, Homo Sapiens
TSTSIIFLLT

SEQ ID NO: 304 - protein, 10 aa, Homo Sapiens
TGVPGLEAFH

SEQ ID NO: 305 - protein, 10 aa, Homo Sapiens
SLILFATITQ

SEQ ID NO: 306 - protein, 10 aa, Homo Sapiens
FLSVTALLGN

SEQ ID NO: 307 - protein, 10 aa, Homo Sapiens
GVPGLEAFHT

SEQ ID NO: 308 - protein, 10 aa, Homo Sapiens
WISIPFCFLS

SEQ ID NO: 309 - protein, 10 aa, Homo Sapiens
NITSTSIIFL

SEQ ID NO: 310 - protein, 10 aa, Homo Sapiens
LLGNSLILFA

SEQ ID NO: 311 - protein, 10 aa, Homo Sapiens
TALLGNSLIL

SEQ ID NO: 312 - protein, 10 aa, Homo Sapiens
LLTGVPGLEA

SEQ ID NO: 313 - protein, 10 aa, Homo Sapiens
PSLHEPMYYF

SEQ ID NO: 314 - protein, 10 aa, Homo Sapiens
VTALLGNSLI

SEQ ID NO: 315 - protein, 10 aa, Homo Sapiens
STLQNITSTS

SEQ ID NO: 316 - protein, 10 aa, Homo Sapiens
AFHTWISIPF

SEQ ID NO: 317 - protein, 10 aa, Homo Sapiens
SLHEPMYYFL

SEQ ID NO: 318 - protein, 10 aa, Homo Sapiens
FCFLSVTALL

SEQ ID NO: 319 - protein, 10 aa, Homo Sapiens
IIFLLTGVPG

SEQ ID NO: 320 - protein, 10 aa, Homo Sapiens
NSLILFATIT

SEQ ID NO: 321 - protein, 10 aa, Homo Sapiens
TSTLQNITST

SEQ ID NO: 322 - protein, 10 aa, Homo Sapiens
LSVTALLGNS

SEQ ID NO: 323 - protein, 10 aa, Homo Sapiens
TSIIFLLTGV

SEQ ID NO: 324 - protein, 10 aa, Homo Sapiens
ATITQPSLHE

SEQ ID NO: 325 - protein, 10 aa, Homo Sapiens
LGNSLILFAT

SEQ ID NO: 326 - protein, 10 aa, Homo Sapiens
FITSTLQNIT

SEQ ID NO: 327 - protein, 10 aa, Homo Sapiens
TLQNITSTSI

SEQ ID NO: 328 - protein, 10 aa, Homo Sapiens
SIPFCFLSVT

SEQ ID NO: 329 - protein, 10 aa, Homo Sapiens
SVTALLGNSL

SEQ ID NO: 330 - protein, 10 aa, Homo Sapiens
ILFATITQPS

SEQ ID NO: 331 - protein, 10 aa, Homo Sapiens
FATITQPSLH

SEQ ID NO: 332 - protein, 10 aa, Homo Sapiens
GNSLILFATI

SEQ ID NO: 333 - protein, 10 aa, Homo Sapiens
IPFCFLSVTA

SEQ ID NO: 334 - protein, 10 aa, Homo Sapiens
HEPMYYFLSM

SEQ ID NO: 335 - protein, 10 aa, Homo Sapiens
LEAFHTWISI

SEQ ID NO: 336 - protein, 10 aa, Homo Sapiens
CFLSVTALLG

SEQ ID NO: 337 - protein, 10 aa, Homo Sapiens
VPGLEAFHTW

SEQ ID NO: 338 - protein, 10 aa, Homo Sapiens
EPMYYFLSML

SEQ ID NO: 339 - protein, 10 aa, Homo Sapiens
PMYYFLSMLS

SEQ ID NO: 340 - protein, 10 aa, Homo Sapiens
LQNITSTSII

SEQ ID NO: 341 - protein, 10 aa, Homo Sapiens
FHTWISIPFC

SEQ ID NO: 342 - protein, 10 aa, Homo Sapiens
FLLTGVPGLE

SEQ ID NO: 343 - protein, 10 aa, Homo Sapiens
SIIFLLTGVP

SEQ ID NO: 344 - protein, 10 aa, Homo Sapiens
LFATITQPSL

SEQ ID NO: 345 - protein, 10 aa, Homo Sapiens
EAFHTWISIP

SEQ ID NO: 346 - protein, 10 aa, Homo Sapiens
LILFATITQP

SEQ ID NO: 347 - protein, 10 aa, Homo Sapiens
IFLLTGVPGL

SEQ ID NO: 348 - protein, 10 aa, Homo Sapiens
TITQPSLHEP

SEQ ID NO: 349 - protein, 10 aa, Homo Sapiens
TWISIPFCFL

SEQ ID NO: 350 - protein, 10 aa, Homo Sapiens
PGLEAFHTWI

SEQ ID NO: 351 - protein, 10 aa, Homo Sapiens
PFCFLSVTAL

SEQ ID NO: 352 - protein, 10 aa, Homo Sapiens
TSPLMNPVIY

SEQ ID NO: 353 - protein, 10 aa, Homo Sapiens
LTSPLMNPVI

SEQ ID NO: 354 - protein, 10 aa, Homo Sapiens
NTYLLTSPLM

SEQ ID NO: 355 - protein, 10 aa, Homo Sapiens
MIANTYLLTS

SEQ ID NO: 356 - protein, 10 aa, Homo Sapiens
TMIANTYLLT

SEQ ID NO: 357 - protein, 10 aa, Homo Sapiens
LLTSPLMNPV

SEQ ID NO: 358 - protein, 10 aa, Homo Sapiens
YLLTSPLMNP

SEQ ID NO: 359 - protein, 10 aa, Homo Sapiens
TYLLTSPLMN

SEQ ID NO: 360 - protein, 10 aa, Homo Sapiens
ANTYLLTSPL

SEQ ID NO: 361 - protein, 10 aa, Homo Sapiens
IANTYLLTSP

SEQ ID NO: 362 - protein, 9 aa, Homo Sapiens
LLLILLSYV

SEQ ID NO: 363 - protein, 9 aa, Homo Sapiens
MLSIFWFNV

SEQ ID NO: 364 - protein, 9 aa, Homo Sapiens
GLLMLTPMV

SEQ ID NO: 365 - protein, 9 aa, Homo Sapiens
ALLIRLSYC

SEQ ID NO: 366 - protein, 9 aa, Homo Sapiens
LMLTPMVAL

SEQ ID NO: 367 - protein, 9 aa, Homo Sapiens
LMNPVIYSV

SEQ ID NO: 368 - protein, 9 aa, Homo Sapiens
GLTAMFSTV

SEQ ID NO: 369 - protein, 9 aa, Homo Sapiens
MLTPMVALL

SEQ ID NO: 370 - protein, 9 aa, Homo Sapiens
RLSYCHSQV

SEQ ID NO: 371 - protein, 9 aa, Homo Sapiens
ILLSYVLII

SEQ ID NO: 372 - protein, 9 aa, Homo Sapiens
MAFDRFVAV

SEQ ID NO: 373 - protein, 9 aa, Homo Sapiens
LISPLMNPV

SEQ ID NO: 374 - protein, 9 aa, Homo Sapiens
LIIRTVLSV

SEQ ID NO: 375 - protein, 9 aa, Homo Sapiens
KLSCTDTRI

SEQ ID NO: 376 - protein, 9 aa, Homo Sapiens
MLSATDLGL

SEQ ID NO: 377 - protein, 9 aa, Homo Sapiens
TVMESSVLL

SEQ ID NO: 378 - protein, 9 aa, Homo Sapiens
LAMAFDRFV

SEQ ID NO: 379 - protein, 9 aa, Homo Sapiens
HMFFIKFFT

SEQ ID NO: 380 - protein, 9 aa, Homo Sapiens
IVAFAIYYI

SEQ ID NO: 381 - protein, 9 aa, Homo Sapiens
ACLSHMFFI

SEQ ID NO: 382 - protein, 9 aa, Homo Sapiens
TMLSIFWFN

SEQ ID NO: 383 - protein, 9 aa, Homo Sapiens
TMIANTYLL

SEQ ID NO: 384 - protein, 9 aa, Homo Sapiens
LLILLSYVL

SEQ ID NO: 385 - protein, 9 aa, Homo Sapiens
LILLSYVLI

SEQ ID NO: 386 - protein, 9 aa, Homo Sapiens
YVLIIRTVL

SEQ ID NO: 387 - protein, 9 aa, Homo Sapiens
LLMLTPMVA

SEQ ID NO: 388 - protein, 9 aa, Homo Sapiens
AMAFDRFVA

SEQ ID NO: 389 - protein, 9 aa, Homo Sapiens
AMILTDSRI

SEQ ID NO: 390 - protein, 9 aa, Homo Sapiens
YVHTMIANT

SEQ ID NO: 391 - protein, 9 aa, Homo Sapiens
SISTLVTML

SEQ ID NO: 392 - protein, 9 aa, Homo Sapiens
YIPLISLSI

SEQ ID NO: 393 - protein, 9 aa, Homo Sapiens
CVSHIVAFA

SEQ ID NO: 394 - protein, 9 aa, Homo Sapiens
SVIRGLLML

SEQ ID NO: 395 - protein, 9 aa, Homo Sapiens
VGLTAMFST

SEQ ID NO: 396 - protein, 9 aa, Homo Sapiens
KQAPAYVHT

SEQ ID NO: 397 - protein, 9 aa, Homo Sapiens
IAQIGVASV

SEQ ID NO: 398 - protein, 9 aa, Homo Sapiens
DLGLSISTL

SEQ ID NO: 399 - protein, 9 aa, Homo Sapiens
MIANTYLLI

SEQ ID NO: 400 - protein, 9 aa, Homo Sapiens
TAMFSTVGV

SEQ ID NO: 401 - protein, 9 aa, Homo Sapiens
MFFIKFFTV

SEQ ID NO: 402 - protein, 9 aa, Homo Sapiens
GLSISTLVT

SEQ ID NO: 403 - protein, 9 aa, Homo Sapiens
LGLSISTLV

SEQ ID NO: 404 - protein, 9 aa, Homo Sapiens
IVHRFGKQA

SEQ ID NO: 405 - protein, 9 aa, Homo Sapiens
SQVLHHSYC

SEQ ID NO: 406 - protein, 9 aa, Homo Sapiens
IPLISLSIV

SEQ ID NO: 407 - protein, 9 aa, Homo Sapiens
NTYLLISPL

SEQ ID NO: 408 - protein, 9 aa, Homo Sapiens
TVGVDLLLI

SEQ ID NO: 409 - protein, 9 aa, Homo Sapiens
GVDLLLILL

SEQ ID NO: 410 - protein, 9 aa, Homo Sapiens
REISFNACL

SEQ ID NO: 411 - protein, 9 aa, Homo Sapiens
FAIYYIPLI

SEQ ID NO: 412 - protein, 9 aa, Homo Sapiens
AVSNPLRYA

SEQ ID NO: 413 - protein, 9 aa, Homo Sapiens
VLHHSYCYH

SEQ ID NO: 414 - protein, 9 aa, Homo Sapiens
VGVDLLLIL

SEQ ID NO: 415 - protein, 9 aa, Homo Sapiens
VMESSVLLA

SEQ ID NO: 416 - protein, 9 aa, Homo Sapiens
LSMLSATDL

SEQ ID NO: 417 - protein, 9 aa, Homo Sapiens
GVASVIRGL

SEQ ID NO: 418 - protein, 9 aa, Homo Sapiens
FSTCVSHIV

SEQ ID NO: 419 - protein, 9 aa, Homo Sapiens
NVREISFNA

SEQ ID NO: 420 - protein, 9 aa, Homo Sapiens
PMVALLIRL

SEQ ID NO: 421 - protein, 9 aa, Homo Sapiens
FSTVGVDLL

SEQ ID NO: 422 - protein, 9 aa, Homo Sapiens
VSHIVAFAI

SEQ ID NO: 423 - protein, 9 aa, Homo Sapiens
LSYVLIIRT

SEQ ID NO: 424 - protein, 9 aa, Homo Sapiens
SATDLGLSI

SEQ ID NO: 425 - protein, 9 aa, Homo Sapiens
FTVMESSVL

SEQ ID NO: 426 - protein, 9 aa, Homo Sapiens
VLLAMAFDR

SEQ ID NO: 427 - protein, 9 aa, Homo Sapiens
VTMLSIFWF

SEQ ID NO: 428 - protein, 9 aa, Homo Sapiens
AQIGVASVI

SEQ ID NO: 429 - protein, 9 aa, Homo Sapiens
FGKQAPAYV

SEQ ID NO: 430 - protein, 9 aa, Homo Sapiens
MESSVLLAM

SEQ ID NO: 431 - protein, 9 aa, Homo Sapiens
MILTDSRIA

SEQ ID NO: 432 - protein, 9 aa, Homo Sapiens
VMKLSCTDT

SEQ ID NO: 433 - protein, 9 aa, Homo Sapiens
LSYCHSQVL

SEQ ID NO: 434 - protein, 9 aa, Homo Sapiens
RINSAVGLT

SEQ ID NO: 435 - protein, 9 aa, Homo Sapiens
VIRGLLMLT

SEQ ID NO: 436 - protein, 9 aa, Homo Sapiens
STVGVDLLL

SEQ ID NO: 437 - protein, 9 aa, Homo Sapiens
RGLLMLTPM

SEQ ID NO: 438 - protein, 9 aa, Homo Sapiens
QIRRAVIKI

SEQ ID NO: 439 - protein, 9 aa, Homo Sapiens
LTPMVALLI

SEQ ID NO: 440 - protein, 9 aa, Homo Sapiens
LTDSRIAQI

SEQ ID NO: 441 - protein, 9 aa, Homo Sapiens
FFTVMESSV

SEQ ID NO: 442 - protein, 9 aa, Homo Sapiens
NPLRYAMIL

SEQ ID NO: 443 - protein, 9 aa, Homo Sapiens
HTMIANTYL

SEQ ID NO: 444 - protein, 9 aa, Homo Sapiens
YFLSMLSAT

SEQ ID NO: 445 - protein, 9 aa, Homo Sapiens
ASPEERKET

SEQ ID NO: 446 - protein, 9 aa, Homo Sapiens
QAPAYVHTM

SEQ ID NO: 447 - protein, 9 aa, Homo Sapiens
LSISTLVTM

SEQ ID NO: 448 - protein, 9 aa, Homo Sapiens
LLIRLSYCH

SEQ ID NO: 449 - protein, 9 aa, Homo Sapiens
VLIIRTVLS

SEQ ID NO: 450 - protein, 9 aa, Homo Sapiens
LLAMAFDRF

SEQ ID NO: 451 - protein, 9 aa, Homo Sapiens
ILTDSRIAQ

SEQ ID NO: 452 - protein, 9 aa, Homo Sapiens
SNPLRYAMI

SEQ ID NO: 453 - protein, 9 aa, Homo Sapiens
SMLSATDLG

SEQ ID NO: 454 - protein, 9 aa, Homo Sapiens
TDTRINSAV

SEQ ID NO: 455 - protein, 9 aa, Homo Sapiens
IIRTVLSVA

SEQ ID NO: 456 - protein, 9 aa, Homo Sapiens
SLSIVHRFG

SEQ ID NO: 457 - protein, 9 aa, Homo Sapiens
PLMNPVIYS

SEQ ID NO: 458 - protein, 9 aa, Homo Sapiens
NSAVGLTAM

SEQ ID NO: 459 - protein, 9 aa, Homo Sapiens
TLVTMLSIF

SEQ ID NO: 460 - protein, 9 aa, Homo Sapiens
FLLTGVPGL

SEQ ID NO: 461 - protein, 9 aa, Homo Sapiens
WISIPFCFL

SEQ ID NO: 462 - protein, 9 aa, Homo Sapiens
ALLGNSLIL

SEQ ID NO: 463 - protein, 9 aa, Homo Sapiens
SIIFLLTGV

SEQ ID NO: 464 - protein, 9 aa, Homo Sapiens
SIPFCFLSV

SEQ ID NO: 465 - protein, 9 aa, Homo Sapiens
FITSTLQNI

SEQ ID NO: 466 - protein, 9 aa, Homo Sapiens
GLEAFHTWI

SEQ ID NO: 467 - protein, 9 aa, Homo Sapiens
SLILFATIT

SEQ ID NO: 468 - protein, 9 aa, Homo Sapiens
PMYYFLSML

SEQ ID NO: 469 - protein, 9 aa, Homo Sapiens
ITSTSIIFL

SEQ ID NO: 470 - protein, 9 aa, Homo Sapiens
FCFLSVTAL

SEQ ID NO: 471 - protein, 9 aa, Homo Sapiens
SLHEPMYYF

SEQ ID NO: 472 - protein, 9 aa, Homo Sapiens
TSTSIIFLL

SEQ ID NO: 473 - protein, 9 aa, Homo Sapiens
LQNITSTSI

SEQ ID NO: 474 - protein, 9 aa, Homo Sapiens
FATITQPSL

SEQ ID NO: 475 - protein, 9 aa, Homo Sapiens
IPFCFLSVT

SEQ ID NO: 476 - protein, 9 aa, Homo Sapiens
STLQNITST

SEQ ID NO: 477 - protein, 9 aa, Homo Sapiens
LGNSLILFA

SEQ ID NO: 478 - protein, 9 aa, Homo Sapiens
GNSLILFAT

SEQ ID NO: 479 - protein, 9 aa, Homo Sapiens
TALLGNSLI

SEQ ID NO: 480 - protein, 9 aa, Homo Sapiens
VTALLGNSL

SEQ ID NO: 481 - protein, 9 aa, Homo Sapiens
VPGLEAFHT

SEQ ID NO: 482 - protein, 9 aa, Homo Sapiens
NSLILFATI

SEQ ID NO: 483 - protein, 9 aa, Homo Sapiens
FLSVTALLG

SEQ ID NO: 484 - protein, 9 aa, Homo Sapiens
LLGNSLILF

SEQ ID NO: 485 - protein, 9 aa, Homo Sapiens
TQPSLHEPM

SEQ ID NO: 486 - protein, 9 aa, Homo Sapiens
HTWISIPFC

SEQ ID NO: 487 - protein, 9 aa, Homo Sapiens
ILFATITQP

SEQ ID NO: 488 - protein, 9 aa, Homo Sapiens
STSIIFLLT

SEQ ID NO: 489 - protein, 9 aa, Homo Sapiens
LTGVPGLEA

SEQ ID NO: 490 - protein, 9 aa, Homo Sapiens
TLQNITSTS

SEQ ID NO: 491 - protein, 9 aa, Homo Sapiens
ITSTLQNIT

SEQ ID NO: 492 - protein, 9 aa, Homo Sapiens
EAFHTWISI

SEQ ID NO: 493 - protein, 9 aa, Homo Sapiens
CFLSVTALL

SEQ ID NO: 494 - protein, 9 aa, Homo Sapiens
GVPGLEAFH

SEQ ID NO: 495 - protein, 9 aa, Homo Sapiens
QNITSTSII

SEQ ID NO: 496 - protein, 9 aa, Homo Sapiens
ISIPFCFLS

SEQ ID NO: 497 - protein, 9 aa, Homo Sapiens
EPMYYFLSM

SEQ ID NO: 498 - protein, 9 aa, Homo Sapiens
LHEPMYYFL

SEQ ID NO: 499 - protein, 9 aa, Homo Sapiens
LILFATITQ

SEQ ID NO: 500 - protein, 9 aa, Homo Sapiens
LEAFHTWIS

SEQ ID NO: 501 - protein, 9 aa, Homo Sapiens
TSIIFLLTG

SEQ ID NO: 502 - protein, 9 aa, Homo Sapiens
NITSTSIIF

SEQ ID NO: 503 - protein, 9 aa, Homo Sapiens
LLTGVPGLE

SEQ ID NO: 504 - protein, 9 aa, Homo Sapiens
TITQPSLHE

SEQ ID NO: 505 - protein, 9 aa, Homo Sapiens
SVTALLGNS

SEQ ID NO: 506 - protein, 9 aa, Homo Sapiens
LSVTALLGN

SEQ ID NO: 507 - protein, 9 aa, Homo Sapiens
ATITQPSLH

SEQ ID NO: 508 - protein, 9 aa, Homo Sapiens
ITQPSLHEP

SEQ ID NO: 509 - protein, 9 aa, Homo Sapiens
IIFLLTGVP

SEQ ID NO: 510 - protein, 9 aa, Homo Sapiens
TGVPGLEAF

SEQ ID NO: 511 - protein, 9 aa, Homo Sapiens
TSTLQNITS

SEQ ID NO: 512 - protein, 9 aa, Homo Sapiens
QPSLHEPMY

SEQ ID NO: 513 - protein, 9 aa, Homo Sapiens
HEPMYYFLS

SEQ ID NO: 514 - protein, 9 aa, Homo Sapiens
IFLLTGVPG

SEQ ID NO: 515 - protein, 9 aa, Homo Sapiens
PGLEAFHTW

SEQ ID NO: 516 - protein, 9 aa, Homo Sapiens
FHTWISIPF

SEQ ID NO: 517 - protein, 9 aa, Homo Sapiens
PSLHEPMYY

SEQ ID NO: 518 - protein, 9 aa, Homo Sapiens
LFATITQPS

SEQ ID NO: 519 - protein, 9 aa, Homo Sapiens
PFCFLSVTA

SEQ ID NO: 520 - protein, 9 aa, Homo Sapiens
TWISIPFCF

SEQ ID NO: 521 - protein, 9 aa, Homo Sapiens
AFHTWISIP

SEQ ID NO: 522 - protein, 9 aa, Homo Sapiens
LTSPLMNPV

SEQ ID NO: 523 - protein, 9 aa, Homo Sapiens
MIANTYLLT

SEQ ID NO: 524 - protein, 9 aa, Homo Sapiens
YLLTSPLMN

SEQ ID NO: 525 - protein, 9 aa, Homo Sapiens
NTYLLTSPL

SEQ ID NO: 526 - protein, 9 aa, Homo Sapiens
LLTSPLMNP

SEQ ID NO: 527 - protein, 9 aa, Homo Sapiens
TSPLMNPVI

SEQ ID NO: 528 - protein, 9 aa, Homo Sapiens
IANTYLLTS

SEQ ID NO: 529 - protein, 9 aa, Homo Sapiens
TYLLTSPLM

SEQ ID NO: 530 - protein, 9 aa, Homo Sapiens
ANTYLLTSP

SEQ ID NO: 531 - protein, 10 aa, Homo Sapiens
TMLSIFWFNV

SEQ ID NO: 532 - protein, 10 aa, Homo Sapiens
LLAMAFDRFV

SEQ ID NO: 533 - protein, 10 aa, Homo Sapiens
LLMLTPMVAL

SEQ ID NO: 534 - protein, 10 aa, Homo Sapiens
LLISPLMNPV

SEQ ID NO: 535 - protein, 10 aa, Homo Sapiens
VLIIRTVLSV

SEQ ID NO: 536 - protein, 10 aa, Homo Sapiens
DLLLILLSYV

SEQ ID NO: 537 - protein, 10 aa, Homo Sapiens
LMLTPMVALL

SEQ ID NO: 538 - protein, 10 aa, Homo Sapiens
ILTDSRIAQI

SEQ ID NO: 539 - protein, 10 aa, Homo Sapiens
FLSMLSATDL

SEQ ID NO: 540 - protein, 10 aa, Homo Sapiens
AMAFDRFVAV

SEQ ID NO: 541 - protein, 10 aa, Homo Sapiens
HMFFIKFFTV

SEQ ID NO: 542 - protein, 10 aa, Homo Sapiens
AMFSTVGVDL

SEQ ID NO: 543 - protein, 10 aa, Homo Sapiens
SMLSATDLGL

SEQ ID NO: 544 - protein, 10 aa, Homo Sapiens
LLLILLSYVL

SEQ ID NO: 545 - protein, 10 aa, Homo Sapiens
YIPLISLSIV

SEQ ID NO: 546 - protein, 10 aa, Homo Sapiens
LLSYVLIIRT

SEQ ID NO: 547 - protein, 10 aa, Homo Sapiens
LLILLSYVLI

SEQ ID NO: 548 - protein, 10 aa, Homo Sapiens
RIAQIGVASV

SEQ ID NO: 549 - protein, 10 aa, Homo Sapiens
AIYYIPLISL

SEQ ID NO: 550 - protein, 10 aa, Homo Sapiens
MLTPMVALLI

SEQ ID NO: 551 - protein, 10 aa, Homo Sapiens
TVMESSVLLA

SEQ ID NO: 552 - protein, 10 aa, Homo Sapiens
PLMNPVIYSV

SEQ ID NO: 553 - protein, 10 aa, Homo Sapiens
GLSISTLVTM

SEQ ID NO: 554 - protein, 10 aa, Homo Sapiens
TMIANTYLLI

SEQ ID NO: 555 - protein, 10 aa, Homo Sapiens
NACLSHMFFI

SEQ ID NO: 556 - protein, 10 aa, Homo Sapiens
RLSYCHSQVL

SEQ ID NO: 557 - protein, 10 aa, Homo Sapiens
AVGLTAMFST

SEQ ID NO: 558 - protein, 10 aa, Homo Sapiens
KQIRRAVIKI

SEQ ID NO: 559 - protein, 10 aa, Homo Sapiens
LILLSYVLII

SEQ ID NO: 560 - protein, 10 aa, Homo Sapiens
VIYSVKTKQI

SEQ ID NO: 561 - protein, 10 aa, Homo Sapiens
GLLMLTPMVA

SEQ ID NO: 562 - protein, 10 aa, Homo Sapiens
VALLIRLSYC

SEQ ID NO: 563 - protein, 10 aa, Homo Sapiens
VGLTAMFSTV

SEQ ID NO: 564 - protein, 10 aa, Homo Sapiens
CVSHIVAFAI

SEQ ID NO: 565 - protein, 10 aa, Homo Sapiens
DLGLSISTLV

SEQ ID NO: 566 - protein, 10 aa, Homo Sapiens
YCYHPDVMKL

SEQ ID NO: 567 - protein, 10 aa, Homo Sapiens
KQAPAYVHTM

SEQ ID NO: 568 - protein, 10 aa, Homo Sapiens
VAFAIYYIPL

SEQ ID NO: 569 - protein, 10 aa, Homo Sapiens
SIVHRFGKQA

SEQ ID NO: 570 - protein, 10 aa, Homo Sapiens
YAMILTDSRI

SEQ ID NO: 571 - protein, 10 aa, Homo Sapiens
SIFWFNVREI

SEQ ID NO: 572 - protein, 10 aa, Homo Sapiens
VGVDLLLILL

SEQ ID NO: 573 - protein, 10 aa, Homo Sapiens
TVGVDLLLIL

SEQ ID NO: 574 - protein, 10 aa, Homo Sapiens
RGLLMLTPMV

SEQ ID NO: 575 - protein, 10 aa, Homo Sapiens
LTAMFSTVGV

SEQ ID NO: 576 - protein, 10 aa, Homo Sapiens
SVIRGLLMLT

SEQ ID NO: 577 - protein, 10 aa, Homo Sapiens
FTVMESSVLL

SEQ ID NO: 578 - protein, 10 aa, Homo Sapiens
TPMVALLIRL

SEQ ID NO: 579 - protein, 10 aa, Homo Sapiens
LSYVLIIRTV

SEQ ID NO: 580 - protein, 10 aa, Homo Sapiens
LIIRTVLSVA

SEQ ID NO: 581 - protein, 10 aa, Homo Sapiens
LAMAFDRFVA

SEQ ID NO: 582 - protein, 10 aa, Homo Sapiens
LISPLMNPVI

SEQ ID NO: 583 - protein, 10 aa, Homo Sapiens
VMESSVLLAM

SEQ ID NO: 584 - protein, 10 aa, Homo Sapiens
FNVREISFNA

SEQ ID NO: 585 - protein, 10 aa, Homo Sapiens
LVTMLSIFWF

SEQ ID NO: 586 - protein, 10 aa, Homo Sapiens
RINSAVGLTA

SEQ ID NO: 587 - protein, 10 aa, Homo Sapiens
FSTVGVDLLL

SEQ ID NO: 588 - protein, 10 aa, Homo Sapiens
KFFTVMESSV

SEQ ID NO: 589 - protein, 10 aa, Homo Sapiens
HIVAFAIYYI

SEQ ID NO: 590 - protein, 10 aa, Homo Sapiens
SHMFFIKFFT

SEQ ID NO: 591 - protein, 10 aa, Homo Sapiens
YLLISPLMNP

SEQ ID NO: 592 - protein, 10 aa, Homo Sapiens
LSISTLVTML

SEQ ID NO: 593 - protein, 10 aa, Homo Sapiens
CLSHMFFIKF

SEQ ID NO: 594 - protein, 10 aa, Homo Sapiens
VTMLSIFWFN

SEQ ID NO: 595 - protein, 10 aa, Homo Sapiens
ISFNACLSHM

SEQ ID NO: 596 - protein, 10 aa, Homo Sapiens
VLLAMAFDRF

SEQ ID NO: 597 - protein, 10 aa, Homo Sapiens
AVSNPLRYAM

SEQ ID NO: 598 - protein, 10 aa, Homo Sapiens
NPLRYAMILT

SEQ ID NO: 599 - protein, 10 aa, Homo Sapiens
TCVSHIVAFA

SEQ ID NO: 600 - protein, 10 aa, Homo Sapiens
TLVTMLSIFW

SEQ ID NO: 601 - protein, 10 aa, Homo Sapiens
CTDTRINSAV

SEQ ID NO: 602 - protein, 10 aa, Homo Sapiens
MESSVLLAMA

SEQ ID NO: 603 - protein, 10 aa, Homo Sapiens
STVGVDLLLI

SEQ ID NO: 604 - protein, 10 aa, Homo Sapiens
ANTYLLISPL

SEQ ID NO: 605 - protein, 10 aa, Homo Sapiens
ASVIRGLLML

SEQ ID NO: 606 - protein, 10 aa, Homo Sapiens
SCTDTRINSA

SEQ ID NO: 607 - protein, 10 aa, Homo Sapiens
VAVSNPLRYA

SEQ ID NO: 608 - protein, 10 aa, Homo Sapiens
AMILTDSRIA

SEQ ID NO: 609 - protein, 10 aa, Homo Sapiens
ALLIRLSYCH

SEQ ID NO: 610 - protein, 10 aa, Homo Sapiens
ISTLVTMLSI

SEQ ID NO: 611 - protein, 10 aa, Homo Sapiens
RFGKQAPAYV

SEQ ID NO: 612 - protein, 10 aa, Homo Sapiens
NVREISFNAC

SEQ ID NO: 613 - protein, 10 aa, Homo Sapiens
TDLGLSISTL

SEQ ID NO: 614 - protein, 10 aa, Homo Sapiens
GVASVIRGLL

SEQ ID NO: 615 - protein, 10 aa, Homo Sapiens
NTYLLISPLM

SEQ ID NO: 616 - protein, 10 aa, Homo Sapiens
QIRRAVIKIL

SEQ ID NO: 617 - protein, 10 aa, Homo Sapiens
QVLHHSYCYH

SEQ ID NO: 618 - protein, 10 aa, Homo Sapiens
LLIRLSYCHS

SEQ ID NO: 619 - protein, 10 aa, Homo Sapiens
DVMKLSCTDT

SEQ ID NO: 620 - protein, 10 aa, Homo Sapiens
VASPEERKET

SEQ ID NO: 621 - protein, 10 aa, Homo Sapiens
VSNPLRYAMI

SEQ ID NO: 622 - protein, 10 aa, Homo Sapiens
QAPAYVHTMI

SEQ ID NO: 623 - protein, 10 aa, Homo Sapiens
VHTMIANTYL

SEQ ID NO: 624 - protein, 10 aa, Homo Sapiens
INSAVGLTAM

SEQ ID NO: 625 - protein, 10 aa, Homo Sapiens
LGLSISTLVT

SEQ ID NO: 626 - protein, 10 aa, Homo Sapiens
VASVIRGLLM

SEQ ID NO: 627 - protein, 10 aa, Homo Sapiens
GLTAMFSTVG

SEQ ID NO: 628 - protein, 10 aa, Homo Sapiens
LSATDLGLSI

SEQ ID NO: 629 - protein, 10 aa, Homo Sapiens
YVLIIRTVLS

SEQ ID NO: 630 - protein, 10 aa, Homo Sapiens
IGVASVIRGL

SEQ ID NO: 631 - protein, 10 aa, Homo Sapiens
SLHEPMYYFL

SEQ ID NO: 632 - protein, 10 aa, Homo Sapiens
LLGNSLILFA

SEQ ID NO: 633 - protein, 10 aa, Homo Sapiens
NITSTSIIFL

SEQ ID NO: 634 - protein, 10 aa, Homo Sapiens
TLQNITSTSI

SEQ ID NO: 635 - protein, 10 aa, Homo Sapiens
LLTGVPGLEA

SEQ ID NO: 636 - protein, 10 aa, Homo Sapiens
ITSTSIIFLL

SEQ ID NO: 637 - protein, 10 aa, Homo Sapiens
GVPGLEAFHT

SEQ ID NO: 638 - protein, 10 aa, Homo Sapiens
SIPFCFLSVT

SEQ ID NO: 639 - protein, 10 aa, Homo Sapiens
FCFLSVTALL

SEQ ID NO: 640 - protein, 10 aa, Homo Sapiens
FITSTLQNIT

SEQ ID NO: 641 - protein, 10 aa, Homo Sapiens
SVTALLGNSL

SEQ ID NO: 642 - protein, 10 aa, Homo Sapiens
ISIPFCFLSV

SEQ ID NO: 643 - protein, 10 aa, Homo Sapiens
LGNSLILFAT

SEQ ID NO: 644 - protein, 10 aa, Homo Sapiens
TSIIFLLTGV

SEQ ID NO: 645 - protein, 10 aa, Homo Sapiens
WISIPFCFLS

SEQ ID NO: 646 - protein, 10 aa, Homo Sapiens
FLSVTALLGN

SEQ ID NO: 647 - protein, 10 aa, Homo Sapiens
LQNITSTSII

SEQ ID NO: 648 - protein, 10 aa, Homo Sapiens
ALLGNSLILF

SEQ ID NO: 649 - protein, 10 aa, Homo Sapiens
LEAFHTWISI

SEQ ID NO: 650 - protein, 10 aa, Homo Sapiens
PGLEAFHTWI

SEQ ID NO: 651 - protein, 10 aa, Homo Sapiens
ILFATITQPS

SEQ ID NO: 652 - protein, 10 aa, Homo Sapiens
TALLGNSLIL

SEQ ID NO: 653 - protein, 10 aa, Homo Sapiens
EPMYYFLSML

SEQ ID NO: 654 - protein, 10 aa, Homo Sapiens
NSLILFATIT

SEQ ID NO: 655 - protein, 10 aa, Homo Sapiens
VTALLGNSLI

SEQ ID NO: 656 - protein, 10 aa, Homo Sapiens
IFLLTGVPGL

SEQ ID NO: 657 - protein, 10 aa, Homo Sapiens
IPFCFLSVTA

SEQ ID NO: 658 - protein, 10 aa, Homo Sapiens
FHTWISIPFC

SEQ ID NO: 659 - protein, 10 aa, Homo Sapiens
GNSLILFATI

SEQ ID NO: 660 - protein, 10 aa, Homo Sapiens
TSTLQNITST

SEQ ID NO: 661 - protein, 10 aa, Homo Sapiens
TSTSIIFLLT

SEQ ID NO: 662 - protein, 10 aa, Homo Sapiens
IIFLLTGVPG

SEQ ID NO: 663 - protein, 10 aa, Homo Sapiens
ITQPSLHEPM

SEQ ID NO: 664 - protein, 10 aa, Homo Sapiens
FLLTGVPGLE

SEQ ID NO: 665 - protein, 10 aa, Homo Sapiens
TWISIPFCFL

SEQ ID NO: 666 - protein, 10 aa, Homo Sapiens
LILFATITQP

SEQ ID NO: 667 - protein, 10 aa, Homo Sapiens
LFATITQPSL

SEQ ID NO: 668 - protein, 10 aa, Homo Sapiens
SLILFATITQ

SEQ ID NO: 669 - protein, 10 aa, Homo Sapiens
GLEAFHTWIS

SEQ ID NO: 670 - protein, 10 aa, Homo Sapiens
STSIIFLLTG

SEQ ID NO: 671 - protein, 10 aa, Homo Sapiens
TQPSLHEPMY

SEQ ID NO: 672 - protein, 10 aa, Homo Sapiens
HEPMYYFLSM

SEQ ID NO: 673 - protein, 10 aa, Homo Sapiens
FATITQPSLH

SEQ ID NO: 674 - protein, 10 aa, Homo Sapiens
TITQPSLHEP

SEQ ID NO: 675 - protein, 10 aa, Homo Sapiens
STLQNITSTS

SEQ ID NO: 676 - protein, 10 aa, Homo Sapiens
PMYYFLSMLS

SEQ ID NO: 677 - protein, 10 aa, Homo Sapiens
TGVPGLEAFH

SEQ ID NO: 678 - protein, 10 aa, Homo Sapiens
QPSLHEPMYY

SEQ ID NO: 679 - protein, 10 aa, Homo Sapiens
LTGVPGLEAF

SEQ ID NO: 680 - protein, 10 aa, Homo Sapiens
ITSTLQNITS

SEQ ID NO: 681 - protein, 10 aa, Homo Sapiens
HTWISIPFCF

SEQ ID NO: 682 - protein, 10 aa, Homo Sapiens
VPGLEAFHTW

SEQ ID NO: 683 - protein, 10 aa, Homo Sapiens
PFCFLSVTAL

SEQ ID NO: 684 - protein, 10 aa, Homo Sapiens
PSLHEPMYYF

SEQ ID NO: 685 - protein, 10 aa, Homo Sapiens
LSVTALLGNS

SEQ ID NO: 686 - protein, 10 aa, Homo Sapiens
ATITQPSLHE

SEQ ID NO: 687 - protein, 10 aa, Homo Sapiens
QNITSTSIIF

SEQ ID NO: 688 - protein, 10 aa, Homo Sapiens
CFLSVTALLG

SEQ ID NO: 689 - protein, 10 aa, Homo Sapiens
SIIFLLTGVP

SEQ ID NO: 690 - protein, 10 aa, Homo Sapiens
EAFHTWISIP

SEQ ID NO: 691 - protein, 10 aa, Homo Sapiens
AFHTWISIPF

SEQ ID NO: 692 - protein, 10 aa, Homo Sapiens
LHEPMYYFLS

SEQ ID NO: 693 - protein, 10 aa, Homo Sapiens
LLTSPLMNPV

SEQ ID NO: 694 - protein, 10 aa, Homo Sapiens
TMIANTYLLT

SEQ ID NO: 695 - protein, 10 aa, Homo Sapiens
YLLTSPLMNP

SEQ ID NO: 696 - protein, 10 aa, Homo Sapiens
NTYLLTSPLM

SEQ ID NO: 697 - protein, 10 aa, Homo Sapiens
ANTYLLTSPL

SEQ ID NO: 698 - protein, 10 aa, Homo Sapiens
LTSPLMNPVI

SEQ ID NO: 699 - protein, 10 aa, Homo Sapiens
MIANTYLLTS

SEQ ID NO: 700 - protein, 10 aa, Homo Sapiens
IANTYLLTSP

SEQ ID NO: 701 - protein, 10 aa, Homo Sapiens
TSPLMNPVIY

SEQ ID NO: 702 - protein, 10 aa, Homo Sapiens
TYLLTSPLMN

SEQ ID NO: 703 - protein, 9 aa, Homo Sapiens
CLSHMFFIK

SEQ ID NO: 704 - protein, 9 aa, Homo Sapiens
LLSYVLIIR

SEQ ID NO: 705 - protein, 9 aa, Homo Sapiens
VLLAMAFDR

SEQ ID NO: 706 - protein, 9 aa, Homo Sapiens
ILLSYVLII

SEQ ID NO: 707 - protein, 9 aa, Homo Sapiens
DLLLILLSY

SEQ ID NO: 708 - protein, 9 aa, Homo Sapiens
AVIKILHSK

SEQ ID NO: 709 - protein, 9 aa, Homo Sapiens
LLAMAFDRF

SEQ ID NO: 710 - protein, 9 aa, Homo Sapiens
TLVTMLSIF

SEQ ID NO: 711 - protein, 9 aa, Homo Sapiens
HIVAFAIYY

SEQ ID NO: 712 - protein, 9 aa, Homo Sapiens
SVASPEERK

SEQ ID NO: 713 - protein, 9 aa, Homo Sapiens
TMIANTYLL

SEQ ID NO: 714 - protein, 9 aa, Homo Sapiens
MLTPMVALL

SEQ ID NO: 715 - protein, 9 aa, Homo Sapiens
KQIRRAVIK

SEQ ID NO: 716 - protein, 9 aa, Homo Sapiens
LLILLSYVL

SEQ ID NO: 717 - protein, 9 aa, Homo Sapiens
HMFFIKFFT

SEQ ID NO: 718 - protein, 9 aa, Homo Sapiens
LMNPVIYSV

SEQ ID NO: 719 - protein, 9 aa, Homo Sapiens
LMLTPMVAL

SEQ ID NO: 720 - protein, 9 aa, Homo Sapiens
GLTAMFSTV

SEQ ID NO: 721 - protein, 9 aa, Homo Sapiens
MLSIFWFNV

SEQ ID NO: 722 - protein, 9 aa, Homo Sapiens
KLSCTDTRI

SEQ ID NO: 723 - protein, 9 aa, Homo Sapiens
QVLHHSYCY

SEQ ID NO: 724 - protein, 9 aa, Homo Sapiens
YCYHPDVMK

SEQ ID NO: 725 - protein, 9 aa, Homo Sapiens
VMESSVLLA

SEQ ID NO: 726 - protein, 9 aa, Homo Sapiens
MLSATDLGL

SEQ ID NO: 727 - protein, 9 aa, Homo Sapiens
LLIRLSYCH

SEQ ID NO: 728 - protein, 9 aa, Homo Sapiens
GLLMLTPMV

SEQ ID NO: 729 - protein, 9 aa, Homo Sapiens
AMILTDSRI

SEQ ID NO: 730 - protein, 9 aa, Homo Sapiens
SVKTKQIRR

SEQ ID NO: 731 - protein, 9 aa, Homo Sapiens
VTMLSIFWF

SEQ ID NO: 732 - protein, 9 aa, Homo Sapiens
LLMLTPMVA

SEQ ID NO: 733 - protein, 9 aa, Homo Sapiens
LISLSIVHR

SEQ ID NO: 734 - protein, 9 aa, Homo Sapiens
AMAFDRFVA

SEQ ID NO: 735 - protein, 9 aa, Homo Sapiens
GLSISTLVT

SEQ ID NO: 736 - protein, 9 aa, Homo Sapiens
GVDLLLILL

SEQ ID NO: 737 - protein, 9 aa, Homo Sapiens
ALLIRLSYC

SEQ ID NO: 738 - protein, 9 aa, Homo Sapiens
LLLILLSYV

SEQ ID NO: 739 - protein, 9 aa, Homo Sapiens
LSIVHRFGK

SEQ ID NO: 740 - protein, 9 aa, Homo Sapiens
PVIYSVKTK

SEQ ID NO: 741 - protein, 9 aa, Homo Sapiens
TMLSIFWFN

SEQ ID NO: 742 - protein, 9 aa, Homo Sapiens
QIGVASVIR

SEQ ID NO: 743 - protein, 9 aa, Homo Sapiens
FVAVSNPLR

SEQ ID NO: 744 - protein, 9 aa, Homo Sapiens
QIRRAVIKI

SEQ ID NO: 745 - protein, 9 aa, Homo Sapiens
DLGLSISTL

SEQ ID NO: 746 - protein, 9 aa, Homo Sapiens
PMVALLIRL

SEQ ID NO: 747 - protein, 9 aa, Homo Sapiens
LSIFWFNVR

SEQ ID NO: 748 - protein, 9 aa, Homo Sapiens
SVIRGLLML

SEQ ID NO: 749 - protein, 9 aa, Homo Sapiens
IVAFAIYYI

SEQ ID NO: 750 - protein, 9 aa, Homo Sapiens
NTYLLISPL

SEQ ID NO: 751 - protein, 9 aa, Homo Sapiens
STVGVDLLL

SEQ ID NO: 752 - protein, 9 aa, Homo Sapiens
RLSYCHSQV

SEQ ID NO: 753 - protein, 9 aa, Homo Sapiens
VLHHSYCYH

SEQ ID NO: 754 - protein, 9 aa, Homo Sapiens
YIPLISLSI

SEQ ID NO: 755 - protein, 9 aa, Homo Sapiens
SISTLVTML

SEQ ID NO: 756 - protein, 9 aa, Homo Sapiens
TVGVDLLLI

SEQ ID NO: 757 - protein, 9 aa, Homo Sapiens
LIIRTVLSV

SEQ ID NO: 758 - protein, 9 aa, Homo Sapiens
LSHMFFIKF

SEQ ID NO: 759 - protein, 9 aa, Homo Sapiens
TPMVALLIR

SEQ ID NO: 760 - protein, 9 aa, Homo Sapiens
VALLIRLSY

SEQ ID NO: 761 - protein, 9 aa, Homo Sapiens
TVMESSVLL

SEQ ID NO: 762 - protein, 9 aa, Homo Sapiens
NVREISFNA

SEQ ID NO: 763 - protein, 9 aa, Homo Sapiens
YVLIIRTVL

SEQ ID NO: 764 - protein, 9 aa, Homo Sapiens
LLISPLMNP

SEQ ID NO: 765 - protein, 9 aa, Homo Sapiens
STLVTMLSI

SEQ ID NO: 766 - protein, 9 aa, Homo Sapiens
VAVSNPLRY

SEQ ID NO: 767 - protein, 9 aa, Homo Sapiens
MIANTYLLI

SEQ ID NO: 768 - protein, 9 aa, Homo Sapiens
VMKLSCTDT

SEQ ID NO: 769 - protein, 9 aa, Homo Sapiens
CVSHIVAFA

SEQ ID NO: 770 - protein, 9 aa, Homo Sapiens
LTPMVALLI

SEQ ID NO: 771 - protein, 9 aa, Homo Sapiens
AMFSTVGVD

SEQ ID NO: 772 - protein, 9 aa, Homo Sapiens
LILLSYVLI

SEQ ID NO: 773 - protein, 9 aa, Homo Sapiens
ISLSIVHRF

SEQ ID NO: 774 - protein, 9 aa, Homo Sapiens
AQIGVASVI

SEQ ID NO: 775 - protein, 9 aa, Homo Sapiens
MNPVIYSVK

SEQ ID NO: 776 - protein, 9 aa, Homo Sapiens
AIYYIPLIS

SEQ ID NO: 777 - protein, 9 aa, Homo Sapiens
PLISLSIVH

SEQ ID NO: 778 - protein, 9 aa, Homo Sapiens
VLIIRTVLS

SEQ ID NO: 779 - protein, 9 aa, Homo Sapiens
YAMILTDSR

SEQ ID NO: 780 - protein, 9 aa, Homo Sapiens
YLLISPLMN

SEQ ID NO: 781 - protein, 9 aa, Homo Sapiens
SPLMNPVIY

SEQ ID NO: 782 - protein, 9 aa, Homo Sapiens
PLMNPVIYS

SEQ ID NO: 783 - protein, 9 aa, Homo Sapiens
NPLRYAMIL

SEQ ID NO: 784 - protein, 9 aa, Homo Sapiens
IIRTVLSVA

SEQ ID NO: 785 - protein, 9 aa, Homo Sapiens
FTVMESSVL

SEQ ID NO: 786 - protein, 9 aa, Homo Sapiens
HTMIANTYL

SEQ ID NO: 787 - protein, 9 aa, Homo Sapiens
TCVSHIVAF

SEQ ID NO: 788 - protein, 9 aa, Homo Sapiens
VIRGLLMLT

SEQ ID NO: 789 - protein, 9 aa, Homo Sapiens
SAVGLTAMF

SEQ ID NO: 790 - protein, 9 aa, Homo Sapiens
LTDSRIAQI

SEQ ID NO: 791 - protein, 9 aa, Homo Sapiens
LISPLMNPV

SEQ ID NO: 792 - protein, 9 aa, Homo Sapiens
GVASVIRGL

SEQ ID NO: 793 - protein, 9 aa, Homo Sapiens
FAIYYIPLI

SEQ ID NO: 794 - protein, 9 aa, Homo Sapiens
ACLSHMFFI

SEQ ID NO: 795 - protein, 9 aa, Homo Sapiens
NACLSHMFF

SEQ ID NO: 796 - protein, 9 aa, Homo Sapiens
LVTMLSIFW

SEQ ID NO: 797 - protein, 9 aa, Homo Sapiens
ILTDSRIAQ

SEQ ID NO: 798 - protein, 9 aa, Homo Sapiens
YSVKTKQIR

SEQ ID NO: 799 - protein, 9 aa, Homo Sapiens
SIFWFNVRE

SEQ ID NO: 800 - protein, 9 aa, Homo Sapiens
SMLSATDLG

SEQ ID NO: 801 - protein, 9 aa, Homo Sapiens
IVHRFGKQA

SEQ ID NO: 802 - protein, 9 aa, Homo Sapiens
LSVASPEER

SEQ ID NO: 803 - protein, 9 aa, Homo Sapiens
SLHEPMYYF

SEQ ID NO: 804 - protein, 9 aa, Homo Sapiens
LLGNSLILF

SEQ ID NO: 805 - protein, 9 aa, Homo Sapiens
GLEAFHTWI

SEQ ID NO: 806 - protein, 9 aa, Homo Sapiens
ALLGNSLIL

SEQ ID NO: 807 - protein, 9 aa, Homo Sapiens
FLLTGVPGL

SEQ ID NO: 808 - protein, 9 aa, Homo Sapiens
PMYYFLSML

SEQ ID NO: 809 - protein, 9 aa, Homo Sapiens
SLILFATIT

SEQ ID NO: 810 - protein, 9 aa, Homo Sapiens
NITSTSIIF

SEQ ID NO: 811 - protein, 9 aa, Homo Sapiens
WISIPFCFL

SEQ ID NO: 812 - protein, 9 aa, Homo Sapiens
ILFATITQP

SEQ ID NO: 813 - protein, 9 aa, Homo Sapiens
SIPFCFLSV

SEQ ID NO: 814 - protein, 9 aa, Homo Sapiens
ITSTSIIFL

SEQ ID NO: 815 - protein, 9 aa, Homo Sapiens
GVPGLEAFH

SEQ ID NO: 816 - protein, 9 aa, Homo Sapiens
FITSTLQNI

SEQ ID NO: 817 - protein, 9 aa, Homo Sapiens
FCFLSVTAL

SEQ ID NO: 818 - protein, 9 aa, Homo Sapiens
HTWISIPFC

SEQ ID NO: 819 - protein, 9 aa, Homo Sapiens
TLQNITSTS

SEQ ID NO: 820 - protein, 9 aa, Homo Sapiens
STSIIFLLT

SEQ ID NO: 821 - protein, 9 aa, Homo Sapiens
SIIFLLTGV

SEQ ID NO: 822 - protein, 9 aa, Homo Sapiens
FLSVTALLG

SEQ ID NO: 823 - protein, 9 aa, Homo Sapiens
QPSLHEPMY

SEQ ID NO: 824 - protein, 9 aa, Homo Sapiens
LTGVPGLEA

SEQ ID NO: 825 - protein, 9 aa, Homo Sapiens
VTALLGNSL

SEQ ID NO: 826 - protein, 9 aa, Homo Sapiens
IPFCFLSVT

SEQ ID NO: 827 - protein, 9 aa, Homo Sapiens
TSTSIIFLL

SEQ ID NO: 828 - protein, 9 aa, Homo Sapiens
LQNITSTSI

SEQ ID NO: 829 - protein, 9 aa, Homo Sapiens
EAFHTWISI

SEQ ID NO: 830 - protein, 9 aa, Homo Sapiens
EPMYYFLSM

SEQ ID NO: 831 - protein, 9 aa, Homo Sapiens
ATITQPSLH

SEQ ID NO: 832 - protein, 9 aa, Homo Sapiens
TWISIPFCF

SEQ ID NO: 833 - protein, 9 aa, Homo Sapiens
LLTGVPGLE

SEQ ID NO: 834 - protein, 9 aa, Homo Sapiens
NSLILFATI

SEQ ID NO: 835 - protein, 9 aa, Homo Sapiens
STLQNITST

SEQ ID NO: 836 - protein, 9 aa, Homo Sapiens
TALLGNSLI

SEQ ID NO: 837 - protein, 9 aa, Homo Sapiens
TGVPGLEAF

SEQ ID NO: 838 - protein, 9 aa, Homo Sapiens
FHTWISIPF

SEQ ID NO: 839 - protein, 9 aa, Homo Sapiens
PSLHEPMYY

SEQ ID NO: 840 - protein, 9 aa, Homo Sapiens
FATITQPSL

SEQ ID NO: 841 - protein, 9 aa, Homo Sapiens
TITQPSLHE

SEQ ID NO: 842 - protein, 9 aa, Homo Sapiens
LILFATITQ

SEQ ID NO: 843 - protein, 9 aa, Homo Sapiens
TQPSLHEPM

SEQ ID NO: 844 - protein, 9 aa, Homo Sapiens
ITSTLQNIT

SEQ ID NO: 845 - protein, 9 aa, Homo Sapiens
GNSLILFAT

SEQ ID NO: 846 - protein, 9 aa, Homo Sapiens
ISIPFCFLS

SEQ ID NO: 847 - protein, 9 aa, Homo Sapiens
VPGLEAFHT

SEQ ID NO: 848 - protein, 9 aa, Homo Sapiens
IIFLLTGVP

SEQ ID NO: 849 - protein, 9 aa, Homo Sapiens
LHEPMYYFL

SEQ ID NO: 850 - protein, 9 aa, Homo Sapiens
ITQPSLHEP

SEQ ID NO: 851 - protein, 9 aa, Homo Sapiens
QNITSTSII

SEQ ID NO: 852 - protein, 9 aa, Homo Sapiens
SVTALLGNS

SEQ ID NO: 853 - protein, 9 aa, Homo Sapiens
CFLSVTALL

SEQ ID NO: 854 - protein, 9 aa, Homo Sapiens
TSIIFLLTG

SEQ ID NO: 855 - protein, 9 aa, Homo Sapiens
HEPMYYFLS

SEQ ID NO: 856 - protein, 9 aa, Homo Sapiens
LGNSLILFA

SEQ ID NO: 857 - protein, 9 aa, Homo Sapiens
LSVTALLGN

SEQ ID NO: 858 - protein, 9 aa, Homo Sapiens
TSTLQNITS

SEQ ID NO: 859 - protein, 9 aa, Homo Sapiens
LEAFHTWIS

SEQ ID NO: 860 - protein, 9 aa, Homo Sapiens
PGLEAFHTW

SEQ ID NO: 861 - protein, 9 aa, Homo Sapiens
AFHTWISIP

SEQ ID NO: 862 - protein, 9 aa, Homo Sapiens
LFATITQPS

SEQ ID NO: 863 - protein, 9 aa, Homo Sapiens
IFLLTGVPG

SEQ ID NO: 864 - protein, 9 aa, Homo Sapiens
PFCFLSVTA

SEQ ID NO: 865 - protein, 9 aa, Homo Sapiens
NTYLLTSPL

SEQ ID NO: 866 - protein, 9 aa, Homo Sapiens
LLTSPLMNP

SEQ ID NO: 867 - protein, 9 aa, Homo Sapiens
YLLTSPLMN

SEQ ID NO: 868 - protein, 9 aa, Homo Sapiens
LTSPLMNPV

SEQ ID NO: 869 - protein, 9 aa, Homo Sapiens
MIANTYLLT

SEQ ID NO: 870 - protein, 9 aa, Homo Sapiens
IANTYLLTS

SEQ ID NO: 871 - protein, 9 aa, Homo Sapiens
TSPLMNPVI

SEQ ID NO: 872 - protein, 9 aa, Homo Sapiens
TYLLTSPLM

SEQ ID NO: 873 - protein, 9 aa, Homo Sapiens
ANTYLLTSP

SEQ ID NO: 874 - protein, 10 aa, Homo Sapiens
SLSIVHRFGK

SEQ ID NO: 875 - protein, 10 aa, Homo Sapiens
LMNPVIYSVK

SEQ ID NO: 876 - protein, 10 aa, Homo Sapiens
CLSHMFFIKF

SEQ ID NO: 877 - protein, 10 aa, Homo Sapiens
MLSIFWFNVR

SEQ ID NO: 878 - protein, 10 aa, Homo Sapiens
ILLSYVLIIR

SEQ ID NO: 879 - protein, 10 aa, Homo Sapiens
HMFFIKFFTV

SEQ ID NO: 880 - protein, 10 aa, Homo Sapiens
VLLAMAFDRF

SEQ ID NO: 881 - protein, 10 aa, Homo Sapiens
AMFSTVGVDL

SEQ ID NO: 882 - protein, 10 aa, Homo Sapiens
VLSVASPEER

SEQ ID NO: 883 - protein, 10 aa, Homo Sapiens
VMKLSCTDTR

SEQ ID NO: 884 - protein, 10 aa, Homo Sapiens
LLLILLSYVL

SEQ ID NO: 885 - protein, 10 aa, Homo Sapiens
ACLSHMFFIK

SEQ ID NO: 886 - protein, 10 aa, Homo Sapiens
TMLSIFWFNV

SEQ ID NO: 887 - protein, 10 aa, Homo Sapiens
LMLTPMVALL

SEQ ID NO: 888 - protein, 10 aa, Homo Sapiens
MLTPMVALLI

SEQ ID NO: 889 - protein, 10 aa, Homo Sapiens
LLMLTPMVAL

SEQ ID NO: 890 - protein, 10 aa, Homo Sapiens
SMLSATDLGL

SEQ ID NO: 891 - protein, 10 aa, Homo Sapiens
GLLMLTPMVA

SEQ ID NO: 892 - protein, 10 aa, Homo Sapiens
VLIIRTVLSV

SEQ ID NO: 893 - protein, 10 aa, Homo Sapiens
TMIANTYLLI

SEQ ID NO: 894 - protein, 10 aa, Homo Sapiens
SVLLAMAFDR

SEQ ID NO: 895 - protein, 10 aa, Homo Sapiens
LILLSYVLII

SEQ ID NO: 896 - protein, 10 aa, Homo Sapiens
AIYYIPLISL

SEQ ID NO: 897 - protein, 10 aa, Homo Sapiens
MVALLIRLSY

SEQ ID NO: 898 - protein, 10 aa, Homo Sapiens
GLSISTLVTM

SEQ ID NO: 899 - protein, 10 aa, Homo Sapiens
VMESSVLLAM

SEQ ID NO: 900 - protein, 10 aa, Homo Sapiens
LISLSIVHRF

SEQ ID NO: 901 - protein, 10 aa, Homo Sapiens
PLISLSIVHR

SEQ ID NO: 902 - protein, 10 aa, Homo Sapiens
LVTMLSIFWF

SEQ ID NO: 903 - protein, 10 aa, Homo Sapiens
ALLIRLSYCH

SEQ ID NO: 904 - protein, 10 aa, Homo Sapiens
ILTDSRIAQI

SEQ ID NO: 905 - protein, 10 aa, Homo Sapiens
LLILLSYVLI

SEQ ID NO: 906 - protein, 10 aa, Homo Sapiens
FVAVSNPLRY

SEQ ID NO: 907 - protein, 10 aa, Homo Sapiens
RAVIKILHSK

SEQ ID NO: 908 - protein, 10 aa, Homo Sapiens
LTPMVALLIR

SEQ ID NO: 909 - protein, 10 aa, Homo Sapiens
FLSMLSATDL

SEQ ID NO: 910 - protein, 10 aa, Homo Sapiens
RLSYCHSQVL

SEQ ID NO: 911 - protein, 10 aa, Homo Sapiens
YVHTMIANTY

SEQ ID NO: 912 - protein, 10 aa, Homo Sapiens
TLVTMLSIFW

SEQ ID NO: 913 - protein, 10 aa, Homo Sapiens
AMAFDRFVAV

SEQ ID NO: 914 - protein, 10 aa, Homo Sapiens
SQVLHHSYCY

SEQ ID NO: 915 - protein, 10 aa, Homo Sapiens
KQIRRAVIKI

SEQ ID NO: 916 - protein, 10 aa, Homo Sapiens
LLISPLMNPV

SEQ ID NO: 917 - protein, 10 aa, Homo Sapiens
NPVIYSVKTK

SEQ ID NO: 918 - protein, 10 aa, Homo Sapiens
HIVAFAIYYI

SEQ ID NO: 919 - protein, 10 aa, Homo Sapiens
LLSYVLIIRT

SEQ ID NO: 920 - protein, 10 aa, Homo Sapiens
AQIGVASVIR

SEQ ID NO: 921 - protein, 10 aa, Homo Sapiens
TVMESSVLLA

SEQ ID NO: 922 - protein, 10 aa, Homo Sapiens
CVSHIVAFAI

SEQ ID NO: 923 - protein, 10 aa, Homo Sapiens
KQAPAYVHTM

SEQ ID NO: 924 - protein, 10 aa, Homo Sapiens
STLVTMLSIF

SEQ ID NO: 925 - protein, 10 aa, Homo Sapiens
LSVASPEERK

SEQ ID NO: 926 - protein, 10 aa, Homo Sapiens
STVGVDLLLI

SEQ ID NO: 927 - protein, 10 aa, Homo Sapiens
PLMNPVIYSV

SEQ ID NO: 928 - protein, 10 aa, Homo Sapiens
TVGVDLLLIL

SEQ ID NO: 929 - protein, 10 aa, Homo Sapiens
YCYHPDVMKL

SEQ ID NO: 930 - protein, 10 aa, Homo Sapiens
VLHHSYCYHP

SEQ ID NO: 931 - protein, 10 aa, Homo Sapiens
VAFAIYYIPL

SEQ ID NO: 932 - protein, 10 aa, Homo Sapiens
GLTAMFSTVG

SEQ ID NO: 933 - protein, 10 aa, Homo Sapiens
STCVSHIVAF

SEQ ID NO: 934 - protein, 10 aa, Homo Sapiens
VIYSVKTKQI

SEQ ID NO: 935 - protein, 10 aa, Homo Sapiens
HTMIANTYLL

SEQ ID NO: 936 - protein, 10 aa, Homo Sapiens
DLLLILLSYV

SEQ ID NO: 937 - protein, 10 aa, Homo Sapiens
YLLISPLMNP

SEQ ID NO: 938 - protein, 10 aa, Homo Sapiens
ETFSTCVSHI

SEQ ID NO: 939 - protein, 10 aa, Homo Sapiens
NVREISFNAC

SEQ ID NO: 940 - protein, 10 aa, Homo Sapiens
DLGLSISTLV

SEQ ID NO: 941 - protein, 10 aa, Homo Sapiens
LISPLMNPVI

SEQ ID NO: 942 - protein, 10 aa, Homo Sapiens
KTKQIRRAVI

SEQ ID NO: 943 - protein, 10 aa, Homo Sapiens
SIFWFNVREI

SEQ ID NO: 944 - protein, 10 aa, Homo Sapiens
GVASVIRGLL

SEQ ID NO: 945 - protein, 10 aa, Homo Sapiens
NTYLLISPLM

SEQ ID NO: 946 - protein, 10 aa, Homo Sapiens
QIRRAVIKIL

SEQ ID NO: 947 - protein, 10 aa, Homo Sapiens
LIIRTVLSVA

SEQ ID NO: 948 - protein, 10 aa, Homo Sapiens
RINSAVGLTA

SEQ ID NO: 949 - protein, 10 aa, Homo Sapiens
AVSNPLRYAM

SEQ ID NO: 950 - protein, 10 aa, Homo Sapiens
LLIRLSYCHS

SEQ ID NO: 951 - protein, 10 aa, Homo Sapiens
LLAMAFDRFV

SEQ ID NO: 952 - protein, 10 aa, Homo Sapiens
YSVKTKQIRR

SEQ ID NO: 953 - protein, 10 aa, Homo Sapiens
VSHIVAFAIY

SEQ ID NO: 954 - protein, 10 aa, Homo Sapiens
RIAQIGVASV

SEQ ID NO: 955 - protein, 10 aa, Homo Sapiens
SIVHRFGKQA

SEQ ID NO: 956 - protein, 10 aa, Homo Sapiens
AVGLTAMFST

SEQ ID NO: 957 - protein, 10 aa, Homo Sapiens
SVIRGLLMLT

SEQ ID NO: 958 - protein, 10 aa, Homo Sapiens
FTVMESSVLL

SEQ ID NO: 959 - protein, 10 aa, Homo Sapiens
SHIVAFAIYY

SEQ ID NO: 960 - protein, 10 aa, Homo Sapiens
MIANTYLLIS

SEQ ID NO: 961 - protein, 10 aa, Homo Sapiens
GVDLLLILLS

SEQ ID NO: 962 - protein, 10 aa, Homo Sapiens
SYCYHPDVMK

SEQ ID NO: 963 - protein, 10 aa, Homo Sapiens
YIPLISLSIV

SEQ ID NO: 964 - protein, 10 aa, Homo Sapiens
QVLHHSYCYH

SEQ ID NO: 965 - protein, 10 aa, Homo Sapiens
AMILTDSRIA

SEQ ID NO: 966 - protein, 10 aa, Homo Sapiens
HRFGKQAPAY

SEQ ID NO: 967 - protein, 10 aa, Homo Sapiens
NACLSHMFFI

SEQ ID NO: 968 - protein, 10 aa, Homo Sapiens
TPMVALLIRL

SEQ ID NO: 969 - protein, 10 aa, Homo Sapiens
VDLLLILLSY

SEQ ID NO: 970 - protein, 10 aa, Homo Sapiens
FIKFFTVMES

SEQ ID NO: 971 - protein, 10 aa, Homo Sapiens
LSHMFFIKFF

SEQ ID NO: 972 - protein, 10 aa, Homo Sapiens
VTMLSIFWFN

SEQ ID NO: 973 - protein, 10 aa, Homo Sapiens
TKQIRRAVIK

SEQ ID NO: 974 - protein, 10 aa, Homo Sapiens
ALLGNSLILF

SEQ ID NO: 975 - protein, 10 aa, Homo Sapiens
SLHEPMYYFL

SEQ ID NO: 976 - protein, 10 aa, Homo Sapiens
HTWISIPFCF

SEQ ID NO: 977 - protein, 10 aa, Homo Sapiens
LLTGVPGLEA

SEQ ID NO: 978 - protein, 10 aa, Homo Sapiens
LLGNSLILFA

SEQ ID NO: 979 - protein, 10 aa, Homo Sapiens
TLQNITSTSI

SEQ ID NO: 980 - protein, 10 aa, Homo Sapiens
GLEAFHTWIS

SEQ ID NO: 981 - protein, 10 aa, Homo Sapiens
ILFATITQPS

SEQ ID NO: 982 - protein, 10 aa, Homo Sapiens
ITSTSIIFLL

SEQ ID NO: 983 - protein, 10 aa, Homo Sapiens
NITSTSIIFL

SEQ ID NO: 984 - protein, 10 aa, Homo Sapiens
LTGVPGLEAF

SEQ ID NO: 985 - protein, 10 aa, Homo Sapiens
GVPGLEAFHT

SEQ ID NO: 986 - protein, 10 aa, Homo Sapiens
TQPSLHEPMY

SEQ ID NO: 987 - protein, 10 aa, Homo Sapiens
QPSLHEPMYY

SEQ ID NO: 988 - protein, 10 aa, Homo Sapiens
SVTALLGNSL

SEQ ID NO: 989 - protein, 10 aa, Homo Sapiens
SLILFATITQ

SEQ ID NO: 990 - protein, 10 aa, Homo Sapiens
FLSVTALLGN

SEQ ID NO: 991 - protein, 10 aa, Homo Sapiens
SIPFCFLSVT

SEQ ID NO: 992 - protein, 10 aa, Homo Sapiens
FCFLSVTALL

SEQ ID NO: 993 - protein, 10 aa, Homo Sapiens
PMYYFLSMLS

SEQ ID NO: 994 - protein, 10 aa, Homo Sapiens
WISIPFCFLS

SEQ ID NO: 995 - protein, 10 aa, Homo Sapiens
VTALLGNSLI

SEQ ID NO: 996 - protein, 10 aa, Homo Sapiens
LQNITSTSII

SEQ ID NO: 997 - protein, 10 aa, Homo Sapiens
TALLGNSLIL

SEQ ID NO: 998 - protein, 10 aa, Homo Sapiens
ITQPSLHEPM

SEQ ID NO: 999 - protein, 10 aa, Homo Sapiens
FLLTGVPGLE

SEQ ID NO: 1000 - protein, 10 aa, Homo Sapiens
ISIPFCFLSV

SEQ ID NO: 1001 - protein, 10 aa, Homo Sapiens
EPMYYFLSML

SEQ ID NO: 1002 - protein, 10 aa, Homo Sapiens
QNITSTSIIF

SEQ ID NO: 1003 - protein, 10 aa, Homo Sapiens
GNSLILFATI

SEQ ID NO: 1004 - protein, 10 aa, Homo Sapiens
HEPMYYFLSM

SEQ ID NO: 1005 - protein, 10 aa, Homo Sapiens
PSLHEPMYYF

SEQ ID NO: 1006 - protein, 10 aa, Homo Sapiens
FITSTLQNIT

SEQ ID NO: 1007 - protein, 10 aa, Homo Sapiens
IIFLLTGVPG

SEQ ID NO: 1008 - protein, 10 aa, Homo Sapiens
IPFCFLSVTA

SEQ ID NO: 1009 - protein, 10 aa, Homo Sapiens
STSIIFLLTG

SEQ ID NO: 1010 - protein, 10 aa, Homo Sapiens
AFHTWISIPF

SEQ ID NO: 1011 - protein, 10 aa, Homo Sapiens
VPGLEAFHTW

SEQ ID NO: 1012 - protein, 10 aa, Homo Sapiens
TSTSIIFLLT

SEQ ID NO: 1013 - protein, 10 aa, Homo Sapiens
ATITQPSLHE

SEQ ID NO: 1014 - protein, 10 aa, Homo Sapiens
STLQNITSTS

SEQ ID NO: 1015 - protein, 10 aa, Homo Sapiens
LILFATITQP

SEQ ID NO: 1016 - protein, 10 aa, Homo Sapiens
TWISIPFCFL

SEQ ID NO: 1017 - protein, 10 aa, Homo Sapiens
ITSTLQNITS

SEQ ID NO: 1018 - protein, 10 aa, Homo Sapiens
LEAFHTWISI

SEQ ID NO: 1019 - protein, 10 aa, Homo Sapiens
TITQPSLHEP

SEQ ID NO: 1020 - protein, 10 aa, Homo Sapiens
IFLLTGVPGL

SEQ ID NO: 1021 - protein, 10 aa, Homo Sapiens
NSLILFATIT

SEQ ID NO: 1022 - protein, 10 aa, Homo Sapiens
TSIIFLLTGV

SEQ ID NO: 1023 - protein, 10 aa, Homo Sapiens
FATITQPSLH

SEQ ID NO: 1024 - protein, 10 aa, Homo Sapiens
EAFHTWISIP

SEQ ID NO: 1025 - protein, 10 aa, Homo Sapiens
SIIFLLTGVP

SEQ ID NO: 1026 - protein, 10 aa, Homo Sapiens
TSTLQNITST

SEQ ID NO: 1027 - protein, 10 aa, Homo Sapiens
LGNSLILFAT

SEQ ID NO: 1028 - protein, 10 aa, Homo Sapiens
LFATITQPSL

SEQ ID NO: 1029 - protein, 10 aa, Homo Sapiens
LHEPMYYFLS

SEQ ID NO: 1030 - protein, 10 aa, Homo Sapiens
TGVPGLEAFH

SEQ ID NO: 1031 - protein, 10 aa, Homo Sapiens
PGLEAFHTWI

SEQ ID NO: 1032 - protein, 10 aa, Homo Sapiens
FHTWISIPFC

SEQ ID NO: 1033 - protein, 10 aa, Homo Sapiens
PFCFLSVTAL

SEQ ID NO: 1034 - protein, 10 aa, Homo Sapiens
LSVTALLGNS

SEQ ID NO: 1035 - protein, 10 aa, Homo Sapiens
CFLSVTALLG

SEQ ID NO: 1036 - protein, 10 aa, Homo Sapiens
TMIANTYLLT

SEQ ID NO: 1037 - protein, 10 aa, Homo Sapiens
LLTSPLMNPV

SEQ ID NO: 1038 - protein, 10 aa, Homo Sapiens
YLLTSPLMNP

SEQ ID NO: 1039 - protein, 10 aa, Homo Sapiens
NTYLLTSPLM

SEQ ID NO: 1040 - protein, 10 aa, Homo Sapiens
LTSPLMNPVI

SEQ ID NO: 1041 - protein, 10 aa, Homo Sapiens
MIANTYLLTS

SEQ ID NO: 1042 - protein, 10 aa, Homo Sapiens
TSPLMNPVIY

SEQ ID NO: 1043 - protein, 10 aa, Homo Sapiens
ANTYLLTSPL

SEQ ID NO: 1044 - protein, 10 aa, Homo Sapiens
IANTYLLTSP

SEQ ID NO: 1045 - protein, 10 aa, Homo Sapiens
TYLLTSPLMN

SEQ ID NO: 1046 - protein, 9 aa, Homo Sapiens
AVIKILHSK

SEQ ID NO: 1047 - protein, 9 aa, Homo Sapiens
KQIRRAVIK

SEQ ID NO: 1048 - protein, 9 aa, Homo Sapiens
SVASPEERK

SEQ ID NO: 1049 - protein, 9 aa, Homo Sapiens
CLSHMFFIK

SEQ ID NO: 1050 - protein, 9 aa, Homo Sapiens
SVKTKQIRR

SEQ ID NO: 1051 - protein, 9 aa, Homo Sapiens
FVAVSNPLR

SEQ ID NO: 1052 - protein, 9 aa, Homo Sapiens
YCYHPDVMK

SEQ ID NO: 1053 - protein, 9 aa, Homo Sapiens
VLLAMAFDR

SEQ ID NO: 1054 - protein, 9 aa, Homo Sapiens
LLSYVLIIR

SEQ ID NO: 1055 - protein, 9 aa, Homo Sapiens
TPMVALLIR

SEQ ID NO: 1056 - protein, 9 aa, Homo Sapiens
PVIYSVKTK

SEQ ID NO: 1057 - protein, 9 aa, Homo Sapiens
GVDLLLILL

SEQ ID NO: 1058 - protein, 9 aa, Homo Sapiens
LSIVHRFGK

SEQ ID NO: 1059 - protein, 9 aa, Homo Sapiens
LISLSIVHR

SEQ ID NO: 1060 - protein, 9 aa, Homo Sapiens
YAMILTDSR

SEQ ID NO: 1061 - protein, 9 aa, Homo Sapiens
QIGVASVIR

SEQ ID NO: 1062 - protein, 9 aa, Homo Sapiens
NVREISFNA

SEQ ID NO: 1063 - protein, 9 aa, Homo Sapiens
VTMLSIFWF

SEQ ID NO: 1064 - protein, 9 aa, Homo Sapiens
QVLHHSYCY

SEQ ID NO: 1065 - protein, 9 aa, Homo Sapiens
SVIRGLLML

SEQ ID NO: 1066 - protein, 9 aa, Homo Sapiens
TVGVDLLLI

SEQ ID NO: 1067 - protein, 9 aa, Homo Sapiens
LVTMLSIFW

SEQ ID NO: 1068 - protein, 9 aa, Homo Sapiens
IVAFAIYYI

SEQ ID NO: 1069 - protein, 9 aa, Homo Sapiens
TVMESSVLL

SEQ ID NO: 1070 - protein, 9 aa, Homo Sapiens
MNPVIYSVK

SEQ ID NO: 1071 - protein, 9 aa, Homo Sapiens
STVGVDLLL

SEQ ID NO: 1072 - protein, 9 aa, Homo Sapiens
STLVTMLSI

SEQ ID NO: 1073 - protein, 9 aa, Homo Sapiens
YVLIIRTVL

SEQ ID NO: 1074 - protein, 9 aa, Homo Sapiens
HTMIANTYL

SEQ ID NO: 1075 - protein, 9 aa, Homo Sapiens
STCVSHIVA

SEQ ID NO: 1076 - protein, 9 aa, Homo Sapiens
NTYLLISPL

SEQ ID NO: 1077 - protein, 9 aa, Homo Sapiens
LTPMVALLI

SEQ ID NO: 1078 - protein, 9 aa, Homo Sapiens
CVSHIVAFA

SEQ ID NO: 1079 - protein, 9 aa, Homo Sapiens
GLLMLTPMV

SEQ ID NO: 1080 - protein, 9 aa, Homo Sapiens
LLMLTPMVA

SEQ ID NO: 1081 - protein, 9 aa, Homo Sapiens
YYFLSMLSA

SEQ ID NO: 1082 - protein, 9 aa, Homo Sapiens
IYYIPLISL

SEQ ID NO: 1083 - protein, 9 aa, Homo Sapiens
FTVMESSVL

SEQ ID NO: 1084 - protein, 9 aa, Homo Sapiens
MFFIKFFTV

SEQ ID NO: 1085 - protein, 9 aa, Homo Sapiens
MLSIFWFNV

SEQ ID NO: 1086 - protein, 9 aa, Homo Sapiens
AMAFDRFVA

SEQ ID NO: 1087 - protein, 9 aa, Homo Sapiens
KLSCTDTRI

SEQ ID NO: 1088 - protein, 9 aa, Homo Sapiens
GLTAMFSTV

SEQ ID NO: 1089 - protein, 9 aa, Homo Sapiens
LLILLSYVL

SEQ ID NO: 1090 - protein, 9 aa, Homo Sapiens
HIVAFAIYY

SEQ ID NO: 1091 - protein, 9 aa, Homo Sapiens
LLIRLSYCH

SEQ ID NO: 1092 - protein, 9 aa, Homo Sapiens
RLSYCHSQV

SEQ ID NO: 1093 - protein, 9 aa, Homo Sapiens
LIIRTVLSV

SEQ ID NO: 1094 - protein, 9 aa, Homo Sapiens
TMIANTYLL

SEQ ID NO: 1095 - protein, 9 aa, Homo Sapiens
ILLSYVLII

SEQ ID NO: 1096 - protein, 9 aa, Homo Sapiens
CTDTRINSA

SEQ ID NO: 1097 - protein, 9 aa, Homo Sapiens
LTDSRIAQI

SEQ ID NO: 1098 - protein, 9 aa, Homo Sapiens
IVHRFGKQA

SEQ ID NO: 1099 - protein, 9 aa, Homo Sapiens
ACLSHMFFI

SEQ ID NO: 1100 - protein, 9 aa, Homo Sapiens
RFVAVSNPL

SEQ ID NO: 1101 - protein, 9 aa, Homo Sapiens
AQIGVASVI

SEQ ID NO: 1102 - protein, 9 aa, Homo Sapiens
MIANTYLLI

SEQ ID NO: 1103 - protein, 9 aa, Homo Sapiens
MLSATDLGL

SEQ ID NO: 1104 - protein, 9 aa, Homo Sapiens
QIRRAVIKI

SEQ ID NO: 1105 - protein, 9 aa, Homo Sapiens
YIPLISLSI

SEQ ID NO: 1106 - protein, 9 aa, Homo Sapiens
LMNPVIYSV

SEQ ID NO: 1107 - protein, 9 aa, Homo Sapiens
CYHPDVMKL

SEQ ID NO: 1108 - protein, 9 aa, Homo Sapiens
VMESSVLLA

SEQ ID NO: 1109 - protein, 9 aa, Homo Sapiens
LSVASPEER

SEQ ID NO: 1110 - protein, 9 aa, Homo Sapiens
MKLSCTDTR

SEQ ID NO: 1111 - protein, 9 aa, Homo Sapiens
YSVKTKQIR

SEQ ID NO: 1112 - protein, 9 aa, Homo Sapiens
LSIFWFNVR

SEQ ID NO: 1113 - protein, 9 aa, Homo Sapiens
GVASVIRGL

SEQ ID NO: 1114 - protein, 9 aa, Homo Sapiens
TLVTMLSIF

SEQ ID NO: 1115 - protein, 9 aa, Homo Sapiens
RFGKQAPAY

SEQ ID NO: 1116 - protein, 9 aa, Homo Sapiens
TYLLISPLM

SEQ ID NO: 1117 - protein, 9 aa, Homo Sapiens
NPLRYAMIL

SEQ ID NO: 1118 - protein, 9 aa, Homo Sapiens
LILLSYVLI

SEQ ID NO: 1119 - protein, 9 aa, Homo Sapiens
ETFSTCVSH

SEQ ID NO: 1120 - protein, 9 aa, Homo Sapiens
AMILTDSRI

SEQ ID NO: 1121 - protein, 9 aa, Homo Sapiens
VAVSNPLRY

SEQ ID NO: 1122 - protein, 9 aa, Homo Sapiens
VALLIRLSY

SEQ ID NO: 1123 - protein, 9 aa, Homo Sapiens
LMLTPMVAL

SEQ ID NO: 1124 - protein, 9 aa, Homo Sapiens
LLLILLSYV

SEQ ID NO: 1125 - protein, 9 aa, Homo Sapiens
RTVLSVASP

SEQ ID NO: 1126 - protein, 9 aa, Homo Sapiens
LLAMAFDRF

SEQ ID NO: 1127 - protein, 9 aa, Homo Sapiens
WFNVREISF

SEQ ID NO: 1128 - protein, 9 aa, Homo Sapiens
IIRTVLSVA

SEQ ID NO: 1129 - protein, 9 aa, Homo Sapiens
AVGLTAMFS

SEQ ID NO: 1130 - protein, 9 aa, Homo Sapiens
TAMFSTVGV

SEQ ID NO: 1131 - protein, 9 aa, Homo Sapiens
MAFDRFVAV

SEQ ID NO: 1132 - protein, 9 aa, Homo Sapiens
SISTLVTML

SEQ ID NO: 1133 - protein, 9 aa, Homo Sapiens
YCHSQVLHH

SEQ ID NO: 1134 - protein, 9 aa, Homo Sapiens
NACLSHMFF

SEQ ID NO: 1135 - protein, 9 aa, Homo Sapiens
SYCHSQVLH

SEQ ID NO: 1136 - protein, 9 aa, Homo Sapiens
SYCYHPDVM

SEQ ID NO: 1137 - protein, 9 aa, Homo Sapiens
AFAIYYIPL

SEQ ID NO: 1138 - protein, 9 aa, Homo Sapiens
SATDLGLSI

SEQ ID NO: 1139 - protein, 9 aa, Homo Sapiens
LISPLMNPV

SEQ ID NO: 1140 - protein, 9 aa, Homo Sapiens
VLHHSYCYH

SEQ ID NO: 1141 - protein, 9 aa, Homo Sapiens
MLTPMVALL

SEQ ID NO: 1142 - protein, 9 aa, Homo Sapiens
DLLLILLSY

SEQ ID NO: 1143 - protein, 9 aa, Homo Sapiens
KTKQIRRAV

SEQ ID NO: 1144 - protein, 9 aa, Homo Sapiens
SVLLAMAFD

SEQ ID NO: 1145 - protein, 9 aa, Homo Sapiens
SAVGLTAMF

SEQ ID NO: 1146 - protein, 9 aa, Homo Sapiens
GVPGLEAFH

SEQ ID NO: 1147 - protein, 9 aa, Homo Sapiens
ITSTSIIFL

SEQ ID NO: 1148 - protein, 9 aa, Homo Sapiens
LTGVPGLEA

SEQ ID NO: 1149 - protein, 9 aa, Homo Sapiens
ATITQPSLH

SEQ ID NO: 1150 - protein, 9 aa, Homo Sapiens
ALLGNSLIL

SEQ ID NO: 1151 - protein, 9 aa, Homo Sapiens
GLEAFHTWI

SEQ ID NO: 1152 - protein, 9 aa, Homo Sapiens
VTALLGNSL

SEQ ID NO: 1153 - protein, 9 aa, Homo Sapiens
LLGNSLILF

SEQ ID NO: 1154 - protein, 9 aa, Homo Sapiens
NITSTSIIF

SEQ ID NO: 1155 - protein, 9 aa, Homo Sapiens
SLHEPMYYF

SEQ ID NO: 1156 - protein, 9 aa, Homo Sapiens
SIPFCFLSV

SEQ ID NO: 1157 - protein, 9 aa, Homo Sapiens
TQPSLHEPM

SEQ ID NO: 1158 - protein, 9 aa, Homo Sapiens
LQNITSTSI

SEQ ID NO: 1159 - protein, 9 aa, Homo Sapiens
FLLTGVPGL

SEQ ID NO: 1160 - protein, 9 aa, Homo Sapiens
SIIFLLTGV

SEQ ID NO: 1161 - protein, 9 aa, Homo Sapiens
FITSTLQNI

SEQ ID NO: 1162 - protein, 9 aa, Homo Sapiens
FCFLSVTAL

SEQ ID NO: 1163 - protein, 9 aa, Homo Sapiens
WISIPFCFL

SEQ ID NO: 1164 - protein, 9 aa, Homo Sapiens
TALLGNSLI

SEQ ID NO: 1165 - protein, 9 aa, Homo Sapiens
CFLSVTALL

SEQ ID NO: 1166 - protein, 9 aa, Homo Sapiens
EAFHTWISI

SEQ ID NO: 1167 - protein, 9 aa, Homo Sapiens
EPMYYFLSM

SEQ ID NO: 1168 - protein, 9 aa, Homo Sapiens
FATITQPSL

SEQ ID NO: 1169 - protein, 9 aa, Homo Sapiens
SVTALLGNS

SEQ ID NO: 1170 - protein, 9 aa, Homo Sapiens
QPSLHEPMY

SEQ ID NO: 1171 - protein, 9 aa, Homo Sapiens
HTWISIPFC

SEQ ID NO: 1172 - protein, 9 aa, Homo Sapiens
STSIIFLLT

SEQ ID NO: 1173 - protein, 9 aa, Homo Sapiens
STLQNITST

SEQ ID NO: 1174 - protein, 9 aa, Homo Sapiens
LILFATITQ

SEQ ID NO: 1175 - protein, 9 aa, Homo Sapiens
ITSTLQNIT

SEQ ID NO: 1176 - protein, 9 aa, Homo Sapiens
ITQPSLHEP

SEQ ID NO: 1177 - protein, 9 aa, Homo Sapiens
TWISIPFCF

SEQ ID NO: 1178 - protein, 9 aa, Homo Sapiens
FLSVTALLG

SEQ ID NO: 1179 - protein, 9 aa, Homo Sapiens
IIFLLTGVP

SEQ ID NO: 1180 - protein, 9 aa, Homo Sapiens
PMYYFLSML

SEQ ID NO: 1181 - protein, 9 aa, Homo Sapiens
ILFATITQP

SEQ ID NO: 1182 - protein, 9 aa, Homo Sapiens
TITQPSLHE

SEQ ID NO: 1183 - protein, 9 aa, Homo Sapiens
QNITSTSII

SEQ ID NO: 1184 - protein, 9 aa, Homo Sapiens
SLILFATIT

SEQ ID NO: 1185 - protein, 9 aa, Homo Sapiens
TSTSIIFLL

SEQ ID NO: 1186 - protein, 9 aa, Homo Sapiens
VPGLEAFHT

SEQ ID NO: 1187 - protein, 9 aa, Homo Sapiens
LGNSLILFA

SEQ ID NO: 1188 - protein, 9 aa, Homo Sapiens
LHEPMYYFL

SEQ ID NO: 1189 - protein, 9 aa, Homo Sapiens
TLQNITSTS

SEQ ID NO: 1190 - protein, 9 aa, Homo Sapiens
FHTWISIPF

SEQ ID NO: 1191 - protein, 9 aa, Homo Sapiens
IPFCFLSVT

SEQ ID NO: 1192 - protein, 9 aa, Homo Sapiens
LLTGVPGLE

SEQ ID NO: 1193 - protein, 9 aa, Homo Sapiens
GNSLILFAT

SEQ ID NO: 1194 - protein, 9 aa, Homo Sapiens
TGVPGLEAF

SEQ ID NO: 1195 - protein, 9 aa, Homo Sapiens
NSLILFATI

SEQ ID NO: 1196 - protein, 9 aa, Homo Sapiens
IFLLTGVPG

SEQ ID NO: 1197 - protein, 9 aa, Homo Sapiens
PFCFLSVTA

SEQ ID NO: 1198 - protein, 9 aa, Homo Sapiens
AFHTWISIP

SEQ ID NO: 1199 - protein, 9 aa, Homo Sapiens
LFATITQPS

SEQ ID NO: 1200 - protein, 9 aa, Homo Sapiens
HEPMYYFLS

SEQ ID NO: 1201 - protein, 9 aa, Homo Sapiens
LEAFHTWIS

SEQ ID NO: 1202 - protein, 9 aa, Homo Sapiens
ISIPFCFLS

SEQ ID NO: 1203 - protein, 9 aa, Homo Sapiens
LSVTALLGN

SEQ ID NO: 1204 - protein, 9 aa, Homo Sapiens
PSLHEPMYY

SEQ ID NO: 1205 - protein, 9 aa, Homo Sapiens
TSIIFLLTG

SEQ ID NO: 1206 - protein, 9 aa, Homo Sapiens
TSTLQNITS

SEQ ID NO: 1207 - protein, 9 aa, Homo Sapiens
PGLEAFHTW

SEQ ID NO: 1208 - protein, 9 aa, Homo Sapiens
NTYLLTSPL

SEQ ID NO: 1209 - protein, 9 aa, Homo Sapiens
LTSPLMNPV

SEQ ID NO: 1210 - protein, 9 aa, Homo Sapiens
TYLLTSPLM

SEQ ID NO: 1211 - protein, 9 aa, Homo Sapiens
YLLTSPLMN

SEQ ID NO: 1212 - protein, 9 aa, Homo Sapiens
LLTSPLMNP

SEQ ID NO: 1213 - protein, 9 aa, Homo Sapiens
MIANTYLLT

SEQ ID NO: 1214 - protein, 9 aa, Homo Sapiens
IANTYLLTS

SEQ ID NO: 1215 - protein, 9 aa, Homo Sapiens
TSPLMNPVI

SEQ ID NO: 1216 - protein, 9 aa, Homo Sapiens
ANTYLLTSP

SEQ ID NO: 1217 - protein, 10 aa, Homo Sapiens
SVLLAMAFDR

SEQ ID NO: 1218 - protein, 10 aa, Homo Sapiens
SLSIVHRFGK

SEQ ID NO: 1219 - protein, 10 aa, Homo Sapiens
ACLSHMFFIK

SEQ ID NO: 1220 - protein, 10 aa, Homo Sapiens
RAVIKILHSK

SEQ ID NO: 1221 - protein, 10 aa, Homo Sapiens
LTPMVALLIR

SEQ ID NO: 1222 - protein, 10 aa, Homo Sapiens
SYCYHPDVMK

SEQ ID NO: 1223 - protein, 10 aa, Homo Sapiens
LMNPVIYSVK

SEQ ID NO: 1224 - protein, 10 aa, Homo Sapiens
RYAMILTDSR

SEQ ID NO: 1225 - protein, 10 aa, Homo Sapiens
ILLSYVLIIR

SEQ ID NO: 1226 - protein, 10 aa, Homo Sapiens
AQIGVASVIR

SEQ ID NO: 1227 - protein, 10 aa, Homo Sapiens
RFVAVSNPLR

SEQ ID NO: 1228 - protein, 10 aa, Homo Sapiens
NPVIYSVKTK

SEQ ID NO: 1229 - protein, 10 aa, Homo Sapiens
IYSVKTKQIR

SEQ ID NO: 1230 - protein, 10 aa, Homo Sapiens
TVMESSVLLA

SEQ ID NO: 1231 - protein, 10 aa, Homo Sapiens
MLSIFWFNVR

SEQ ID NO: 1232 - protein, 10 aa, Homo Sapiens
VLSVASPEER

SEQ ID NO: 1233 - protein, 10 aa, Homo Sapiens
VMKLSCTDTR

SEQ ID NO: 1234 - protein, 10 aa, Homo Sapiens
LVTMLSIFWF

SEQ ID NO: 1235 - protein, 10 aa, Homo Sapiens
GVASVIRGLL

SEQ ID NO: 1236 - protein, 10 aa, Homo Sapiens
CVSHIVAFAI

SEQ ID NO: 1237 - protein, 10 aa, Homo Sapiens
KQIRRAVIKI

SEQ ID NO: 1238 - protein, 10 aa, Homo Sapiens
FVAVSNPLRY

SEQ ID NO: 1239 - protein, 10 aa, Homo Sapiens
MVALLIRLSY

SEQ ID NO: 1240 - protein, 10 aa, Homo Sapiens
AVSNPLRYAM

SEQ ID NO: 1241 - protein, 10 aa, Homo Sapiens
HTMIANTYLL

SEQ ID NO: 1242 - protein, 10 aa, Homo Sapiens
TVGVDLLLIL

SEQ ID NO: 1243 - protein, 10 aa, Homo Sapiens
GLLMLTPMVA

SEQ ID NO: 1244 - protein, 10 aa, Homo Sapiens
LSVASPEERK

SEQ ID NO: 1245 - protein, 10 aa, Homo Sapiens
STVGVDLLLI

SEQ ID NO: 1246 - protein, 10 aa, Homo Sapiens
KTKQIRRAVI

SEQ ID NO: 1247 - protein, 10 aa, Homo Sapiens
QVLHHSYCYH

SEQ ID NO: 1248 - protein, 10 aa, Homo Sapiens
HMFFIKFFTV

SEQ ID NO: 1249 - protein, 10 aa, Homo Sapiens
RINSAVGLTA

SEQ ID NO: 1250 - protein, 10 aa, Homo Sapiens
NTYLLISPLM

SEQ ID NO: 1251 - protein, 10 aa, Homo Sapiens
YVHTMIANTY

SEQ ID NO: 1252 - protein, 10 aa, Homo Sapiens
TKQIRRAVIK

SEQ ID NO: 1253 - protein, 10 aa, Homo Sapiens
SQVLHHSYCY

SEQ ID NO: 1254 - protein, 10 aa, Homo Sapiens
TMLSIFWFNV

SEQ ID NO: 1255 - protein, 10 aa, Homo Sapiens
KQAPAYVHTM

SEQ ID NO: 1256 - protein, 10 aa, Homo Sapiens
AIYYIPLISL

SEQ ID NO: 1257 - protein, 10 aa, Homo Sapiens
MYYFLSMLSA

SEQ ID NO: 1258 - protein, 10 aa, Homo Sapiens
STLVTMLSIF

SEQ ID NO: 1259 - protein, 10 aa, Homo Sapiens
FTVMESSVLL

SEQ ID NO: 1260 - protein, 10 aa, Homo Sapiens
YSVKTKQIRR

SEQ ID NO: 1261 - protein, 10 aa, Homo Sapiens
PLISLSIVHR

SEQ ID NO: 1262 - protein, 10 aa, Homo Sapiens
LAMAFDRFVA

SEQ ID NO: 1263 - protein, 10 aa, Homo Sapiens
GVDLLLILLS

SEQ ID NO: 1264 - protein, 10 aa, Homo Sapiens
TMIANTYLLI

SEQ ID NO: 1265 - protein, 10 aa, Homo Sapiens
YYIPLISLSI

SEQ ID NO: 1266 - protein, 10 aa, Homo Sapiens
LILLSYVLII

SEQ ID NO: 1267 - protein, 10 aa, Homo Sapiens
RLSYCHSQVL

SEQ ID NO: 1268 - protein, 10 aa, Homo Sapiens
HIVAFAIYYI

SEQ ID NO: 1269 - protein, 10 aa, Homo Sapiens
RIAQIGVASV

SEQ ID NO: 1270 - protein, 10 aa, Homo Sapiens
KFFTVMESSV

SEQ ID NO: 1271 - protein, 10 aa, Homo Sapiens
TLVTMLSIFW

SEQ ID NO: 1272 - protein, 10 aa, Homo Sapiens
LLLILLSYVL

SEQ ID NO: 1273 - protein, 10 aa, Homo Sapiens
GLSISTLVTM

SEQ ID NO: 1274 - protein, 10 aa, Homo Sapiens
SMLSATDLGL

SEQ ID NO: 1275 - protein, 10 aa, Homo Sapiens
VLIIRTVLSV

SEQ ID NO: 1276 - protein, 10 aa, Homo Sapiens
ALLIRLSYCH

SEQ ID NO: 1277 - protein, 10 aa, Homo Sapiens
CTDTRINSAV

SEQ ID NO: 1278 - protein, 10 aa, Homo Sapiens
LTAMFSTVGV

SEQ ID NO: 1279 - protein, 10 aa, Homo Sapiens
STCVSHIVAF

SEQ ID NO: 1280 - protein, 10 aa, Homo Sapiens
SYCHSQVLHH

SEQ ID NO: 1281 - protein, 10 aa, Homo Sapiens
AMFSTVGVDL

SEQ ID NO: 1282 - protein, 10 aa, Homo Sapiens
CLSHMFFIKF

SEQ ID NO: 1283 - protein, 10 aa, Homo Sapiens
MLTPMVALLI

SEQ ID NO: 1284 - protein, 10 aa, Homo Sapiens
YCYHPDVMKL

SEQ ID NO: 1285 - protein, 10 aa, Homo Sapiens
VMESSVLLAM

SEQ ID NO: 1286 - protein, 10 aa, Homo Sapiens
LLMLTPMVAL

SEQ ID NO: 1287 - protein, 10 aa, Homo Sapiens
VAFAIYYIPL

SEQ ID NO: 1288 - protein, 10 aa, Homo Sapiens
TPMVALLIRL

SEQ ID NO: 1289 - protein, 10 aa, Homo Sapiens
LLISPLMNPV

SEQ ID NO: 1290 - protein, 10 aa, Homo Sapiens
SYVLIIRTVL

SEQ ID NO: 1291 - protein, 10 aa, Homo Sapiens
LLILLSYVLI

SEQ ID NO: 1292 - protein, 10 aa, Homo Sapiens
LIIRTVLSVA

SEQ ID NO: 1293 - protein, 10 aa, Homo Sapiens
NACLSHMFFI

SEQ ID NO: 1294 - protein, 10 aa, Homo Sapiens
RFGKQAPAYV

SEQ ID NO: 1295 - protein, 10 aa, Homo Sapiens
ETFSTCVSHI

SEQ ID NO: 1296 - protein, 10 aa, Homo Sapiens
AVGLTAMFST

SEQ ID NO: 1297 - protein, 10 aa, Homo Sapiens
SVIRGLLMLT

SEQ ID NO: 1298 - protein, 10 aa, Homo Sapiens
VLLAMAFDRF

SEQ ID NO: 1299 - protein, 10 aa, Homo Sapiens
LMLTPMVALL

SEQ ID NO: 1300 - protein, 10 aa, Homo Sapiens
IPLISLSIVH

SEQ ID NO: 1301 - protein, 10 aa, Homo Sapiens
RTVLSVASPE

SEQ ID NO: 1302 - protein, 10 aa, Homo Sapiens
VTMLSIFWFN

SEQ ID NO: 1303 - protein, 10 aa, Homo Sapiens
LISLSIVHRF

SEQ ID NO: 1304 - protein, 10 aa, Homo Sapiens
VIYSVKTKQI

SEQ ID NO: 1305 - protein, 10 aa, Homo Sapiens
YAMILTDSRI

SEQ ID NO: 1306 - protein, 10 aa, Homo Sapiens
MFFIKFFTVM

SEQ ID NO: 1307 - protein, 10 aa, Homo Sapiens
IVAFAIYYIP

SEQ ID NO: 1308 - protein, 10 aa, Homo Sapiens
FLSMLSATDL

SEQ ID NO: 1309 - protein, 10 aa, Homo Sapiens
ILTDSRIAQI

SEQ ID NO: 1310 - protein, 10 aa, Homo Sapiens
YIPLISLSIV

SEQ ID NO: 1311 - protein, 10 aa, Homo Sapiens
LISPLMNPVI

SEQ ID NO: 1312 - protein, 10 aa, Homo Sapiens
APAYVHTMIA

SEQ ID NO: 1313 - protein, 10 aa, Homo Sapiens
VASVIRGLLM

SEQ ID NO: 1314 - protein, 10 aa, Homo Sapiens
AMAFDRFVAV

SEQ ID NO: 1315 - protein, 10 aa, Homo Sapiens
SIVHRFGKQA

SEQ ID NO: 1316 - protein, 10 aa, Homo Sapiens
YVLIIRTVLS

SEQ ID NO: 1317 - protein, 10 aa, Homo Sapiens
HTWISIPFCF

SEQ ID NO: 1318 - protein, 10 aa, Homo Sapiens
ITSTSIIFLL

SEQ ID NO: 1319 - protein, 10 aa, Homo Sapiens
SVTALLGNSL

SEQ ID NO: 1320 - protein, 10 aa, Homo Sapiens
GVPGLEAFHT

SEQ ID NO: 1321 - protein, 10 aa, Homo Sapiens
ALLGNSLILF

SEQ ID NO: 1322 - protein, 10 aa, Homo Sapiens
VTALLGNSLI

SEQ ID NO: 1323 - protein, 10 aa, Homo Sapiens
ITQPSLHEPM

SEQ ID NO: 1324 - protein, 10 aa, Homo Sapiens
LTGVPGLEAF

SEQ ID NO: 1325 - protein, 10 aa, Homo Sapiens
NITSTSIIFL

SEQ ID NO: 1326 - protein, 10 aa, Homo Sapiens
SLHEPMYYFL

SEQ ID NO: 1327 - protein, 10 aa, Homo Sapiens
LLTGVPGLEA

SEQ ID NO: 1328 - protein, 10 aa, Homo Sapiens
LLGNSLILFA

SEQ ID NO: 1329 - protein, 10 aa, Homo Sapiens
TQPSLHEPMY

SEQ ID NO: 1330 - protein, 10 aa, Homo Sapiens
LQNITSTSII

SEQ ID NO: 1331 - protein, 10 aa, Homo Sapiens
TALLGNSLIL

SEQ ID NO: 1332 - protein, 10 aa, Homo Sapiens
IPFCFLSVTA

SEQ ID NO: 1333 - protein, 10 aa, Homo Sapiens
QPSLHEPMYY

SEQ ID NO: 1334 - protein, 10 aa, Homo Sapiens
AFHTWISIPF

SEQ ID NO: 1335 - protein, 10 aa, Homo Sapiens
TLQNITSTSI

SEQ ID NO: 1336 - protein, 10 aa, Homo Sapiens
FCFLSVTALL

SEQ ID NO: 1337 - protein, 10 aa, Homo Sapiens
IFLLTGVPGL

SEQ ID NO: 1338 - protein, 10 aa, Homo Sapiens
ATITQPSLHE

SEQ ID NO: 1339 - protein, 10 aa, Homo Sapiens
GLEAFHTWIS

SEQ ID NO: 1340 - protein, 10 aa, Homo Sapiens
LFATITQPSL

SEQ ID NO: 1341 - protein, 10 aa, Homo Sapiens
FATITQPSLH

SEQ ID NO: 1342 - protein, 10 aa, Homo Sapiens
STSIIFLLTG

SEQ ID NO: 1343 - protein, 10 aa, Homo Sapiens
ITSTLQNITS

SEQ ID NO: 1344 - protein, 10 aa, Homo Sapiens
VPGLEAFHTW

SEQ ID NO: 1345 - protein, 10 aa, Homo Sapiens
STLQNITSTS

SEQ ID NO: 1346 - protein, 10 aa, Homo Sapiens
SLILFATITQ

SEQ ID NO: 1347 - protein, 10 aa, Homo Sapiens
QNITSTSIIF

SEQ ID NO: 1348 - protein, 10 aa, Homo Sapiens
WISIPFCFLS

SEQ ID NO: 1349 - protein, 10 aa, Homo Sapiens
GNSLILFATI

SEQ ID NO: 1350 - protein, 10 aa, Homo Sapiens
LEAFHTWISI

SEQ ID NO: 1351 - protein, 10 aa, Homo Sapiens
HEPMYYFLSM

SEQ ID NO: 1352 - protein, 10 aa, Homo Sapiens
EPMYYFLSML

SEQ ID NO: 1353 - protein, 10 aa, Homo Sapiens
ILFATITQPS

SEQ ID NO: 1354 - protein, 10 aa, Homo Sapiens
IIFLLTGVPG

SEQ ID NO: 1355 - protein, 10 aa, Homo Sapiens
FLSVTALLGN

SEQ ID NO: 1356 - protein, 10 aa, Homo Sapiens
LILFATITQP

SEQ ID NO: 1357 - protein, 10 aa, Homo Sapiens
CFLSVTALLG

SEQ ID NO: 1358 - protein, 10 aa, Homo Sapiens
FLLTGVPGLE

SEQ ID NO: 1359 - protein, 10 aa, Homo Sapiens
ISIPFCFLSV

SEQ ID NO: 1360 - protein, 10 aa, Homo Sapiens
SIIFLLTGVP

SEQ ID NO: 1361 - protein, 10 aa, Homo Sapiens
FITSTLQNIT

SEQ ID NO: 1362 - protein, 10 aa, Homo Sapiens
SIPFCFLSVT

SEQ ID NO: 1363 - protein, 10 aa, Homo Sapiens
TITQPSLHEP

SEQ ID NO: 1364 - protein, 10 aa, Homo Sapiens
TWISIPFCFL

SEQ ID NO: 1365 - protein, 10 aa, Homo Sapiens
TGVPGLEAFH

SEQ ID NO: 1366 - protein, 10 aa, Homo Sapiens
TSIIFLLTGV

SEQ ID NO: 1367 - protein, 10 aa, Homo Sapiens
PFCFLSVTAL

SEQ ID NO: 1368 - protein, 10 aa, Homo Sapiens
PMYYFLSMLS

SEQ ID NO: 1369 - protein, 10 aa, Homo Sapiens
EAFHTWISIP

SEQ ID NO: 1370 - protein, 10 aa, Homo Sapiens
PSLHEPMYYF

SEQ ID NO: 1371 - protein, 10 aa, Homo Sapiens
LGNSLILFAT

SEQ ID NO: 1372 - protein, 10 aa, Homo Sapiens
LHEPMYYFLS

SEQ ID NO: 1373 - protein, 10 aa, Homo Sapiens
TSTSIIFLLT

SEQ ID NO: 1374 - protein, 10 aa, Homo Sapiens
PGLEAFHTWI

SEQ ID NO: 1375 - protein, 10 aa, Homo Sapiens
LSVTALLGNS

SEQ ID NO: 1376 - protein, 10 aa, Homo Sapiens
NSLILFATIT

SEQ ID NO: 1377 - protein, 10 aa, Homo Sapiens
FHTWISIPFC

SEQ ID NO: 1378 - protein, 10 aa, Homo Sapiens
TSTLQNITST

SEQ ID NO: 1379 - protein, 10 aa, Homo Sapiens
NTYLLTSPLM

SEQ ID NO: 1380 - protein, 10 aa, Homo Sapiens
LTSPLMNPVI

SEQ ID NO: 1381 - protein, 10 aa, Homo Sapiens
LLTSPLMNPV

SEQ ID NO: 1382 - protein, 10 aa, Homo Sapiens
YLLTSPLMNP

SEQ ID NO: 1383 - protein, 10 aa, Homo Sapiens
TYLLTSPLMN

SEQ ID NO: 1384 - protein, 10 aa, Homo Sapiens
TMIANTYLLT

SEQ ID NO: 1385 - protein, 10 aa, Homo Sapiens
MIANTYLLTS

SEQ ID NO: 1386 - protein, 10 aa, Homo Sapiens
ANTYLLTSPL

SEQ ID NO: 1387 - protein, 10 aa, Homo Sapiens
IANTYLLTSP

SEQ ID NO: 1388 - protein, 10 aa, Homo Sapiens
TSPLMNPVIY

SEQ ID NO: 1389 - protein, 9 aa, Homo Sapiens
CYHPDVMKL

SEQ ID NO: 1390 - protein, 9 aa, Homo Sapiens
IYYIPLISL

SEQ ID NO: 1391 - protein, 9 aa, Homo Sapiens
RFVAVSNPL

SEQ ID NO: 1392 - protein, 9 aa, Homo Sapiens
TYLLISPLM

SEQ ID NO: 1393 - protein, 9 aa, Homo Sapiens
IYSVKTKQI

SEQ ID NO: 1394 - protein, 9 aa, Homo Sapiens
MFSTVGVDL

SEQ ID NO: 1395 - protein, 9 aa, Homo Sapiens
SYCYHPDVM

SEQ ID NO: 1396 - protein, 9 aa, Homo Sapiens
AFAIYYIPL

SEQ ID NO: 1397 - protein, 9 aa, Homo Sapiens
WFNVREISF

SEQ ID NO: 1398 - protein, 9 aa, Homo Sapiens
RYAMILTDS

SEQ ID NO: 1399 - protein, 9 aa, Homo Sapiens
YYIPLISLS

SEQ ID NO: 1400 - protein, 9 aa, Homo Sapiens
SYVLIIRTV

SEQ ID NO: 1401 - protein, 9 aa, Homo Sapiens
VGVDLLLIL

SEQ ID NO: 1402 - protein, 9 aa, Homo Sapiens
STVGVDLLL

SEQ ID NO: 1403 - protein, 9 aa, Homo Sapiens
YVLIIRTVL

SEQ ID NO: 1404 - protein, 9 aa, Homo Sapiens
AYVHTMIAN

SEQ ID NO: 1405 - protein, 9 aa, Homo Sapiens
LLILLSYVL

SEQ ID NO: 1406 - protein, 9 aa, Homo Sapiens
TVMESSVLL

SEQ ID NO: 1407 - protein, 9 aa, Homo Sapiens
LMLTPMVAL

SEQ ID NO: 1408 - protein, 9 aa, Homo Sapiens
LSMLSATDL

SEQ ID NO: 1409 - protein, 9 aa, Homo Sapiens
TMIANTYLL

SEQ ID NO: 1410 - protein, 9 aa, Homo Sapiens
FTVMESSVL

SEQ ID NO: 1411 - protein, 9 aa, Homo Sapiens
NPLRYAMIL

SEQ ID NO: 1412 - protein, 9 aa, Homo Sapiens
MYYFLSMLS

SEQ ID NO: 1413 - protein, 9 aa, Homo Sapiens
HTMIANTYL

SEQ ID NO: 1414 - protein, 9 aa, Homo Sapiens
SVIRGLLML

SEQ ID NO: 1415 - protein, 9 aa, Homo Sapiens
VASVIRGLL

SEQ ID NO: 1416 - protein, 9 aa, Homo Sapiens
GVASVIRGL

SEQ ID NO: 1417 - protein, 9 aa, Homo Sapiens
IFWFNVREI

SEQ ID NO: 1418 - protein, 9 aa, Homo Sapiens
TFSTCVSHI

SEQ ID NO: 1419 - protein, 9 aa, Homo Sapiens
YYFLSMLSA

SEQ ID NO: 1420 - protein, 9 aa, Homo Sapiens
SISTLVTML

SEQ ID NO: 1421 - protein, 9 aa, Homo Sapiens
LSYCHSQVL

SEQ ID NO: 1422 - protein, 9 aa, Homo Sapiens
MLTPMVALL

SEQ ID NO: 1423 - protein, 9 aa, Homo Sapiens
GVDLLLILL

SEQ ID NO: 1424 - protein, 9 aa, Homo Sapiens
NTYLLISPL

SEQ ID NO: 1425 - protein, 9 aa, Homo Sapiens
FFIKFFTVM

SEQ ID NO: 1426 - protein, 9 aa, Homo Sapiens
ISLSIVHRF

SEQ ID NO: 1427 - protein, 9 aa, Homo Sapiens
FSTVGVDLL

SEQ ID NO: 1428 - protein, 9 aa, Homo Sapiens
MLSATDLGL

SEQ ID NO: 1429 - protein, 9 aa, Homo Sapiens
DLGLSISTL

SEQ ID NO: 1430 - protein, 9 aa, Homo Sapiens
SFNACLSHM

SEQ ID NO: 1431 - protein, 9 aa, Homo Sapiens
SAVGLTAMF

SEQ ID NO: 1432 - protein, 9 aa, Homo Sapiens
SPEERKETF

SEQ ID NO: 1433 - protein, 9 aa, Homo Sapiens
SSVLLAMAF

SEQ ID NO: 1434 - protein, 9 aa, Homo Sapiens
VTMLSIFWF

SEQ ID NO: 1435 - protein, 9 aa, Homo Sapiens
TCVSHIVAF

SEQ ID NO: 1436 - protein, 9 aa, Homo Sapiens
TLVTMLSIF

SEQ ID NO: 1437 - protein, 9 aa, Homo Sapiens
LSHMFFIKF

SEQ ID NO: 1438 - protein, 9 aa, Homo Sapiens
LLAMAFDRF

SEQ ID NO: 1439 - protein, 9 aa, Homo Sapiens
FNACLSHMF

SEQ ID NO: 1440 - protein, 9 aa, Homo Sapiens
LTPMVALLI

SEQ ID NO: 1441 - protein, 9 aa, Homo Sapiens
YIPLISLSI

SEQ ID NO: 1442 - protein, 9 aa, Homo Sapiens
AQIGVASVI

SEQ ID NO: 1443 - protein, 9 aa, Homo Sapiens
KLSCTDTRI

SEQ ID NO: 1444 - protein, 9 aa, Homo Sapiens
NACLSHMFF

SEQ ID NO: 1445 - protein, 9 aa, Homo Sapiens
FAIYYIPLI

SEQ ID NO: 1446 - protein, 9 aa, Homo Sapiens
ILLSYVLII

SEQ ID NO: 1447 - protein, 9 aa, Homo Sapiens
SNPLRYAMI

SEQ ID NO: 1448 - protein, 9 aa, Homo Sapiens
AMILTDSRI

SEQ ID NO: 1449 - protein, 9 aa, Homo Sapiens
ISPLMNPVI

SEQ ID NO: 1450 - protein, 9 aa, Homo Sapiens
STLVTMLSI

SEQ ID NO: 1451 - protein, 9 aa, Homo Sapiens
LILLSYVLI

SEQ ID NO: 1452 - protein, 9 aa, Homo Sapiens
RGLLMLTPM

SEQ ID NO: 1453 - protein, 9 aa, Homo Sapiens
ACLSHMFFI

SEQ ID NO: 1454 - protein, 9 aa, Homo Sapiens
SATDLGLSI

SEQ ID NO: 1455 - protein, 9 aa, Homo Sapiens
KFFTVMESS

SEQ ID NO: 1456 - protein, 9 aa, Homo Sapiens
APAYVHTMI

SEQ ID NO: 1457 - protein, 9 aa, Homo Sapiens
VSHIVAFAI

SEQ ID NO: 1458 - protein, 9 aa, Homo Sapiens
REISFNACL

SEQ ID NO: 1459 - protein, 9 aa, Homo Sapiens
QIRRAVIKI

SEQ ID NO: 1460 - protein, 9 aa, Homo Sapiens
VSNPLRYAM

SEQ ID NO: 1461 - protein, 9 aa, Homo Sapiens
RFGKQAPAY

SEQ ID NO: 1462 - protein, 9 aa, Homo Sapiens
MIANTYLLI

SEQ ID NO: 1463 - protein, 9 aa, Homo Sapiens
IVAFAIYYI

SEQ ID NO: 1464 - protein, 9 aa, Homo Sapiens
TVGVDLLLI

SEQ ID NO: 1465 - protein, 9 aa, Homo Sapiens
LTDSRIAQI

SEQ ID NO: 1466 - protein, 9 aa, Homo Sapiens
ASVIRGLLM

SEQ ID NO: 1467 - protein, 9 aa, Homo Sapiens
YFLSMLSAT

SEQ ID NO: 1468 - protein, 9 aa, Homo Sapiens
QAPAYVHTM

SEQ ID NO: 1469 - protein, 9 aa, Homo Sapiens
LSISTLVTM

SEQ ID NO: 1470 - protein, 9 aa, Homo Sapiens
PMVALLIRL

SEQ ID NO: 1471 - protein, 9 aa, Homo Sapiens
TRINSAVGL

SEQ ID NO: 1472 - protein, 9 aa, Homo Sapiens
MFFIKFFTV

SEQ ID NO: 1473 - protein, 9 aa, Homo Sapiens
IRRAVIKIL

SEQ ID NO: 1474 - protein, 9 aa, Homo Sapiens
FFTVMESSV

SEQ ID NO: 1475 - protein, 9 aa, Homo Sapiens
NSAVGLTAM

SEQ ID NO: 1476 - protein, 9 aa, Homo Sapiens
AFDRFVAVS

SEQ ID NO: 1477 - protein, 9 aa, Homo Sapiens
SYCHSQVLH

SEQ ID NO: 1478 - protein, 9 aa, Homo Sapiens
RAVIKILHS

SEQ ID NO: 1479 - protein, 9 aa, Homo Sapiens
SHMFFIKFF

SEQ ID NO: 1480 - protein, 9 aa, Homo Sapiens
RINSAVGLT

SEQ ID NO: 1481 - protein, 9 aa, Homo Sapiens
KTKQIRRAV

SEQ ID NO: 1482 - protein, 9 aa, Homo Sapiens
RIAQIGVAS

SEQ ID NO: 1483 - protein, 9 aa, Homo Sapiens
TMLSIFWFN

SEQ ID NO: 1484 - protein, 9 aa, Homo Sapiens
LMNPVIYSV

SEQ ID NO: 1485 - protein, 9 aa, Homo Sapiens
KQAPAYVHT

SEQ ID NO: 1486 - protein, 9 aa, Homo Sapiens
DLLLILLSY

SEQ ID NO: 1487 - protein, 9 aa, Homo Sapiens
LGLSISTLV

SEQ ID NO: 1488 - protein, 9 aa, Homo Sapiens
VALLIRLSY

SEQ ID NO: 1489 - protein, 9 aa, Homo Sapiens
CFLSVTALL

SEQ ID NO: 1490 - protein, 9 aa, Homo Sapiens
ALLGNSLIL

SEQ ID NO: 1491 - protein, 9 aa, Homo Sapiens
FLLTGVPGL

SEQ ID NO: 1492 - protein, 9 aa, Homo Sapiens
VTALLGNSL

SEQ ID NO: 1493 - protein, 9 aa, Homo Sapiens
TSTSIIFLL

SEQ ID NO: 1494 - protein, 9 aa, Homo Sapiens
WISIPFCFL

SEQ ID NO: 1495 - protein, 9 aa, Homo Sapiens
TWISIPFCF

SEQ ID NO: 1496 - protein, 9 aa, Homo Sapiens
FATITQPSL

SEQ ID NO: 1497 - protein, 9 aa, Homo Sapiens
ITSTSIIFL

SEQ ID NO: 1498 - protein, 9 aa, Homo Sapiens
FCFLSVTAL

SEQ ID NO: 1499 - protein, 9 aa, Homo Sapiens
TGVPGLEAF

SEQ ID NO: 1500 - protein, 9 aa, Homo Sapiens
SLHEPMYYF

SEQ ID NO: 1501 - protein, 9 aa, Homo Sapiens
NSLILFATI

SEQ ID NO: 1502 - protein, 9 aa, Homo Sapiens
LLGNSLILF

SEQ ID NO: 1503 - protein, 9 aa, Homo Sapiens
NITSTSIIF

SEQ ID NO: 1504 - protein, 9 aa, Homo Sapiens
QNITSTSII

SEQ ID NO: 1505 - protein, 9 aa, Homo Sapiens
TALLGNSLI

SEQ ID NO: 1506 - protein, 9 aa, Homo Sapiens
LQNITSTSI

SEQ ID NO: 1507 - protein, 9 aa, Homo Sapiens
GLEAFHTWI

SEQ ID NO: 1508 - protein, 9 aa, Homo Sapiens
FITSTLQNI

SEQ ID NO: 1509 - protein, 9 aa, Homo Sapiens
EAFHTWISI

SEQ ID NO: 1510 - protein, 9 aa, Homo Sapiens
EPMYYFLSM

SEQ ID NO: 1511 - protein, 9 aa, Homo Sapiens
TQPSLHEPM

SEQ ID NO: 1512 - protein, 9 aa, Homo Sapiens
LFATITQPS

SEQ ID NO: 1513 - protein, 9 aa, Homo Sapiens
LHEPMYYFL

SEQ ID NO: 1514 - protein, 9 aa, Homo Sapiens
PMYYFLSML

SEQ ID NO: 1515 - protein, 9 aa, Homo Sapiens
FHTWISIPF

SEQ ID NO: 1516 - protein, 9 aa, Homo Sapiens
TLQNITSTS

SEQ ID NO: 1517 - protein, 9 aa, Homo Sapiens
ISIPFCFLS

SEQ ID NO: 1518 - protein, 9 aa, Homo Sapiens
LGNSLILFA

SEQ ID NO: 1519 - protein, 9 aa, Homo Sapiens
SIIFLLTGV

SEQ ID NO: 1520 - protein, 9 aa, Homo Sapiens
SIPFCFLSV

SEQ ID NO: 1521 - protein, 9 aa, Homo Sapiens
STSIIFLLT

SEQ ID NO: 1522 - protein, 9 aa, Homo Sapiens
SLILFATIT

SEQ ID NO: 1523 - protein, 9 aa, Homo Sapiens
STLQNITST

SEQ ID NO: 1524 - protein, 9 aa, Homo Sapiens
LSVTALLGN

SEQ ID NO: 1525 - protein, 9 aa, Homo Sapiens
ITSTLQNIT

SEQ ID NO: 1526 - protein, 9 aa, Homo Sapiens
GNSLILFAT

SEQ ID NO: 1527 - protein, 9 aa, Homo Sapiens
SVTALLGNS

SEQ ID NO: 1528 - protein, 9 aa, Homo Sapiens
LTGVPGLEA

SEQ ID NO: 1529 - protein, 9 aa, Homo Sapiens
QPSLHEPMY

SEQ ID NO: 1530 - protein, 9 aa, Homo Sapiens
HTWISIPFC

SEQ ID NO: 1531 - protein, 9 aa, Homo Sapiens
TSTLQNITS

SEQ ID NO: 1532 - protein, 9 aa, Homo Sapiens
IPFCFLSVT

SEQ ID NO: 1533 - protein, 9 aa, Homo Sapiens
VPGLEAFHT

SEQ ID NO: 1534 - protein, 9 aa, Homo Sapiens
IFLLTGVPG

SEQ ID NO: 1535 - protein, 9 aa, Homo Sapiens
PFCFLSVTA

SEQ ID NO: 1536 - protein, 9 aa, Homo Sapiens
AFHTWISIP

SEQ ID NO: 1537 - protein, 9 aa, Homo Sapiens
PGLEAFHTW

SEQ ID NO: 1538 - protein, 9 aa, Homo Sapiens
ITQPSLHEP

SEQ ID NO: 1539 - protein, 9 aa, Homo Sapiens
GVPGLEAFH

SEQ ID NO: 1540 - protein, 9 aa, Homo Sapiens
TSIIFLLTG

SEQ ID NO: 1541 - protein, 9 aa, Homo Sapiens
LILFATITQ

SEQ ID NO: 1542 - protein, 9 aa, Homo Sapiens
PSLHEPMYY

SEQ ID NO: 1543 - protein, 9 aa, Homo Sapiens
ATITQPSLH

SEQ ID NO: 1544 - protein, 9 aa, Homo Sapiens
HEPMYYFLS

SEQ ID NO: 1545 - protein, 9 aa, Homo Sapiens
LLTGVPGLE

SEQ ID NO: 1546 - protein, 9 aa, Homo Sapiens
IIFLLTGVP

SEQ ID NO: 1547 - protein, 9 aa, Homo Sapiens
LEAFHTWIS

SEQ ID NO: 1548 - protein, 9 aa, Homo Sapiens
ILFATITQP

SEQ ID NO: 1549 - protein, 9 aa, Homo Sapiens
FLSVTALLG

SEQ ID NO: 1550 - protein, 9 aa, Homo Sapiens
TITQPSLHE

SEQ ID NO: 1551 - protein, 9 aa, Homo Sapiens
TYLLTSPLM

SEQ ID NO: 1552 - protein, 9 aa, Homo Sapiens
NTYLLTSPL

SEQ ID NO: 1553 - protein, 9 aa, Homo Sapiens
TSPLMNPVI

SEQ ID NO: 1554 - protein, 9 aa, Homo Sapiens
LTSPLMNPV

SEQ ID NO: 1555 - protein, 9 aa, Homo Sapiens
YLLTSPLMN

SEQ ID NO: 1556 - protein, 9 aa, Homo Sapiens
IANTYLLTS

SEQ ID NO: 1557 - protein, 9 aa, Homo Sapiens
MIANTYLLT

SEQ ID NO: 1558 - protein, 9 aa, Homo Sapiens
ANTYLLTSP

SEQ ID NO: 1559 - protein, 9 aa, Homo Sapiens
LLTSPLMNP

SEQ ID NO: 1560 - protein, 10 aa, Homo Sapiens
SYVLIIRTVL

SEQ ID NO: 1561 - protein, 10 aa, Homo Sapiens
YYIPLISLSI

SEQ ID NO: 1562 - protein, 10 aa, Homo Sapiens
MFSTVGVDLL

SEQ ID NO: 1563 - protein, 10 aa, Homo Sapiens
FFTVMESSVL

SEQ ID NO: 1564 - protein, 10 aa, Homo Sapiens
SFNACLSHMF

SEQ ID NO: 1565 - protein, 10 aa, Homo Sapiens
RLSYCHSQVL

SEQ ID NO: 1566 - protein, 10 aa, Homo Sapiens
VGVDLLLILL

SEQ ID NO: 1567 - protein, 10 aa, Homo Sapiens
CYHPDVMKLS

SEQ ID NO: 1568 - protein, 10 aa, Homo Sapiens
IGVASVIRGL

SEQ ID NO: 1569 - protein, 10 aa, Homo Sapiens
TYLLISPLMN

SEQ ID NO: 1570 - protein, 10 aa, Homo Sapiens
AYVHTMIANT

SEQ ID NO: 1571 - protein, 10 aa, Homo Sapiens
TPMVALLIRL

SEQ ID NO: 1572 - protein, 10 aa, Homo Sapiens
LSISTLVTML

SEQ ID NO: 1573 - protein, 10 aa, Homo Sapiens
LLLILLSYVL

SEQ ID NO: 1574 - protein, 10 aa, Homo Sapiens
SMLSATDLGL

SEQ ID NO: 1575 - protein, 10 aa, Homo Sapiens
FTVMESSVLL

SEQ ID NO: 1576 - protein, 10 aa, Homo Sapiens
SNPLRYAMIL

SEQ ID NO: 1577 - protein, 10 aa, Homo Sapiens
LMLTPMVALL

SEQ ID NO: 1578 - protein, 10 aa, Homo Sapiens
ASVIRGLLML

SEQ ID NO: 1579 - protein, 10 aa, Homo Sapiens
LLMLTPMVAL

SEQ ID NO: 1580 - protein, 10 aa, Homo Sapiens
IYYIPLISLS

SEQ ID NO: 1581 - protein, 10 aa, Homo Sapiens
HTMIANTYLL

SEQ ID NO: 1582 - protein, 10 aa, Homo Sapiens
AMFSTVGVDL

SEQ ID NO: 1583 - protein, 10 aa, Homo Sapiens
FSTVGVDLLL

SEQ ID NO: 1584 - protein, 10 aa, Homo Sapiens
QIRRAVIKIL

SEQ ID NO: 1585 - protein, 10 aa, Homo Sapiens
GVASVIRGLL

SEQ ID NO: 1586 - protein, 10 aa, Homo Sapiens
YYFLSMLSAT

SEQ ID NO: 1587 - protein, 10 aa, Homo Sapiens
MYYFLSMLSA

SEQ ID NO: 1588 - protein, 10 aa, Homo Sapiens
AFAIYYIPLI

SEQ ID NO: 1589 - protein, 10 aa, Homo Sapiens
ANTYLLISPL

SEQ ID NO: 1590 - protein, 10 aa, Homo Sapiens
TVGVDLLLIL

SEQ ID NO: 1591 - protein, 10 aa, Homo Sapiens
YCYHPDVMKL

SEQ ID NO: 1592 - protein, 10 aa, Homo Sapiens
DTRINSAVGL

SEQ ID NO: 1593 - protein, 10 aa, Homo Sapiens
VAFAIYYIPL

SEQ ID NO: 1594 - protein, 10 aa, Homo Sapiens
FLSMLSATDL

SEQ ID NO: 1595 - protein, 10 aa, Homo Sapiens
AIYYIPLISL

SEQ ID NO: 1596 - protein, 10 aa, Homo Sapiens
VLLAMAFDRF

SEQ ID NO: 1597 - protein, 10 aa, Homo Sapiens
ASPEERKETF

SEQ ID NO: 1598 - protein, 10 aa, Homo Sapiens
KQIRRAVIKI

SEQ ID NO: 1599 - protein, 10 aa, Homo Sapiens
MFFIKFFTVM

SEQ ID NO: 1600 - protein, 10 aa, Homo Sapiens
STLVTMLSIF

SEQ ID NO: 1601 - protein, 10 aa, Homo Sapiens
LISLSIVHRF

SEQ ID NO: 1602 - protein, 10 aa, Homo Sapiens
CLSHMFFIKF

SEQ ID NO: 1603 - protein, 10 aa, Homo Sapiens
ESSVLLAMAF

SEQ ID NO: 1604 - protein, 10 aa, Homo Sapiens
NSAVGLTAMF

SEQ ID NO: 1605 - protein, 10 aa, Homo Sapiens
QAPAYVHTMI

SEQ ID NO: 1606 - protein, 10 aa, Homo Sapiens
IAQIGVASVI

SEQ ID NO: 1607 - protein, 10 aa, Homo Sapiens
KTKQIRRAVI

SEQ ID NO: 1608 - protein, 10 aa, Homo Sapiens
FNACLSHMFF

SEQ ID NO: 1609 - protein, 10 aa, Homo Sapiens
STCVSHIVAF

SEQ ID NO: 1610 - protein, 10 aa, Homo Sapiens
FWFNVREISF

SEQ ID NO: 1611 - protein, 10 aa, Homo Sapiens
LSHMFFIKFF

SEQ ID NO: 1612 - protein, 10 aa, Homo Sapiens
LVTMLSIFWF

SEQ ID NO: 1613 - protein, 10 aa, Homo Sapiens
VSNPLRYAMI

SEQ ID NO: 1614 - protein, 10 aa, Homo Sapiens
MLTPMVALLI

SEQ ID NO: 1615 - protein, 10 aa, Homo Sapiens
YAMILTDSRI

SEQ ID NO: 1616 - protein, 10 aa, Homo Sapiens
LLILLSYVLI

SEQ ID NO: 1617 - protein, 10 aa, Homo Sapiens
LILLSYVLII

SEQ ID NO: 1618 - protein, 10 aa, Homo Sapiens
HIVAFAIYYI

SEQ ID NO: 1619 - protein, 10 aa, Homo Sapiens
STVGVDLLLI

SEQ ID NO: 1620 - protein, 10 aa, Homo Sapiens
TMIANTYLLI

SEQ ID NO: 1621 - protein, 10 aa, Homo Sapiens
CVSHIVAFAI

SEQ ID NO: 1622 - protein, 10 aa, Homo Sapiens
LISPLMNPVI

SEQ ID NO: 1623 - protein, 10 aa, Homo Sapiens
ILTDSRIAQI

SEQ ID NO: 1624 - protein, 10 aa, Homo Sapiens
LSATDLGLSI

SEQ ID NO: 1625 - protein, 10 aa, Homo Sapiens
KQAPAYVHTM

SEQ ID NO: 1626 - protein, 10 aa, Homo Sapiens
RYAMILTDSR

SEQ ID NO: 1627 - protein, 10 aa, Homo Sapiens
SIFWFNVREI

SEQ ID NO: 1628 - protein, 10 aa, Homo Sapiens
VMESSVLLAM

SEQ ID NO: 1629 - protein, 10 aa, Homo Sapiens
VIYSVKTKQI

SEQ ID NO: 1630 - protein, 10 aa, Homo Sapiens
ETFSTCVSHI

SEQ ID NO: 1631 - protein, 10 aa, Homo Sapiens
NACLSHMFFI

SEQ ID NO: 1632 - protein, 10 aa, Homo Sapiens
ISTLVTMLSI

SEQ ID NO: 1633 - protein, 10 aa, Homo Sapiens
RFGKQAPAYV

SEQ ID NO: 1634 - protein, 10 aa, Homo Sapiens
KFFTVMESSV

SEQ ID NO: 1635 - protein, 10 aa, Homo Sapiens
WFNVREISFN

SEQ ID NO: 1636 - protein, 10 aa, Homo Sapiens
IFWFNVREIS

SEQ ID NO: 1637 - protein, 10 aa, Homo Sapiens
NTYLLISPLM

SEQ ID NO: 1638 - protein, 10 aa, Homo Sapiens
AFDRFVAVSN

SEQ ID NO: 1639 - protein, 10 aa, Homo Sapiens
TFSTCVSHIV

SEQ ID NO: 1640 - protein, 10 aa, Homo Sapiens
DRFVAVSNPL

SEQ ID NO: 1641 - protein, 10 aa, Homo Sapiens
TDLGLSISTL

SEQ ID NO: 1642 - protein, 10 aa, Homo Sapiens
AVSNPLRYAM

SEQ ID NO: 1643 - protein, 10 aa, Homo Sapiens
IYSVKTKQIR

SEQ ID NO: 1644 - protein, 10 aa, Homo Sapiens
VREISFNACL

SEQ ID NO: 1645 - protein, 10 aa, Homo Sapiens
GLSISTLVTM

SEQ ID NO: 1646 - protein, 10 aa, Homo Sapiens
VASVIRGLLM

SEQ ID NO: 1647 - protein, 10 aa, Homo Sapiens
HSYCYHPDVM

SEQ ID NO: 1648 - protein, 10 aa, Homo Sapiens
SYCYHPDVMK

SEQ ID NO: 1649 - protein, 10 aa, Homo Sapiens
ISFNACLSHM

SEQ ID NO: 1650 - protein, 10 aa, Homo Sapiens
SYCHSQVLHH

SEQ ID NO: 1651 - protein, 10 aa, Homo Sapiens
INSAVGLTAM

SEQ ID NO: 1652 - protein, 10 aa, Homo Sapiens
RINSAVGLTA

SEQ ID NO: 1653 - protein, 10 aa, Homo Sapiens
VHTMIANTYL

SEQ ID NO: 1654 - protein, 10 aa, Homo Sapiens
RGLLMLTPMV

SEQ ID NO: 1655 - protein, 10 aa, Homo Sapiens
VTMLSIFWFN

SEQ ID NO: 1656 - protein, 10 aa, Homo Sapiens
LLISPLMNPV

SEQ ID NO: 1657 - protein, 10 aa, Homo Sapiens
FAIYYIPLIS

SEQ ID NO: 1658 - protein, 10 aa, Homo Sapiens
LIIRTVLSVA

SEQ ID NO: 1659 - protein, 10 aa, Homo Sapiens
FNVREISFNA

SEQ ID NO: 1660 - protein, 10 aa, Homo Sapiens
IFLLTGVPGL

SEQ ID NO: 1661 - protein, 10 aa, Homo Sapiens
LFATITQPSL

SEQ ID NO: 1662 - protein, 10 aa, Homo Sapiens
AFHTWISIPF

SEQ ID NO: 1663 - protein, 10 aa, Homo Sapiens
TWISIPFCFL

SEQ ID NO: 1664 - protein, 10 aa, Homo Sapiens
TALLGNSLIL

SEQ ID NO: 1665 - protein, 10 aa, Homo Sapiens
EPMYYFLSML

SEQ ID NO: 1666 - protein, 10 aa, Homo Sapiens
SVTALLGNSL

SEQ ID NO: 1667 - protein, 10 aa, Homo Sapiens
FCFLSVTALL

SEQ ID NO: 1668 - protein, 10 aa, Homo Sapiens
ITSTSIIFLL

SEQ ID NO: 1669 - protein, 10 aa, Homo Sapiens
SLHEPMYYFL

SEQ ID NO: 1670 - protein, 10 aa, Homo Sapiens
NITSTSIIFL

SEQ ID NO: 1671 - protein, 10 aa, Homo Sapiens
QNITSTSIIF

SEQ ID NO: 1672 - protein, 10 aa, Homo Sapiens
ALLGNSLILF

SEQ ID NO: 1673 - protein, 10 aa, Homo Sapiens
HTWISIPFCF

SEQ ID NO: 1674 - protein, 10 aa, Homo Sapiens
PFCFLSVTAL

SEQ ID NO: 1675 - protein, 10 aa, Homo Sapiens
LTGVPGLEAF

SEQ ID NO: 1676 - protein, 10 aa, Homo Sapiens
TLQNITSTSI

SEQ ID NO: 1677 - protein, 10 aa, Homo Sapiens
LQNITSTSII

SEQ ID NO: 1678 - protein, 10 aa, Homo Sapiens
GNSLILFATI

SEQ ID NO: 1679 - protein, 10 aa, Homo Sapiens
ITQPSLHEPM

SEQ ID NO: 1680 - protein, 10 aa, Homo Sapiens
VTALLGNSLI

SEQ ID NO: 1681 - protein, 10 aa, Homo Sapiens
PSLHEPMYYF

SEQ ID NO: 1682 - protein, 10 aa, Homo Sapiens
ISIPFCFLSV

SEQ ID NO: 1683 - protein, 10 aa, Homo Sapiens
STLQNITSTS

SEQ ID NO: 1684 - protein, 10 aa, Homo Sapiens
LGNSLILFAT

SEQ ID NO: 1685 - protein, 10 aa, Homo Sapiens
PGLEAFHTWI

SEQ ID NO: 1686 - protein, 10 aa, Homo Sapiens
TSIIFLLTGV

SEQ ID NO: 1687 - protein, 10 aa, Homo Sapiens
LSVTALLGNS

SEQ ID NO: 1688 - protein, 10 aa, Homo Sapiens
TSTSIIFLLT

SEQ ID NO: 1689 - protein, 10 aa, Homo Sapiens
ILFATITQPS

SEQ ID NO: 1690 - protein, 10 aa, Homo Sapiens
GVPGLEAFHT

SEQ ID NO: 1691 - protein, 10 aa, Homo Sapiens
SIPFCFLSVT

SEQ ID NO: 1692 - protein, 10 aa, Homo Sapiens
NSLILFATIT

SEQ ID NO: 1693 - protein, 10 aa, Homo Sapiens
GLEAFHTWIS

SEQ ID NO: 1694 - protein, 10 aa, Homo Sapiens
TQPSLHEPMY

SEQ ID NO: 1695 - protein, 10 aa, Homo Sapiens
FITSTLQNIT

SEQ ID NO: 1696 - protein, 10 aa, Homo Sapiens
LLGNSLILFA

SEQ ID NO: 1697 - protein, 10 aa, Homo Sapiens
IPFCFLSVTA

SEQ ID NO: 1698 - protein, 10 aa, Homo Sapiens
VPGLEAFHTW

SEQ ID NO: 1699 - protein, 10 aa, Homo Sapiens
LLTGVPGLEA

SEQ ID NO: 1700 - protein, 10 aa, Homo Sapiens
TSTLQNITST

SEQ ID NO: 1701 - protein, 10 aa, Homo Sapiens
QPSLHEPMYY

SEQ ID NO: 1702 - protein, 10 aa, Homo Sapiens
LEAFHTWISI

SEQ ID NO: 1703 - protein, 10 aa, Homo Sapiens
WISIPFCFLS

SEQ ID NO: 1704 - protein, 10 aa, Homo Sapiens
FLSVTALLGN

SEQ ID NO: 1705 - protein, 10 aa, Homo Sapiens
ITSTLQNITS

SEQ ID NO: 1706 - protein, 10 aa, Homo Sapiens
HEPMYYFLSM

SEQ ID NO: 1707 - protein, 10 aa, Homo Sapiens
CFLSVTALLG

SEQ ID NO: 1708 - protein, 10 aa, Homo Sapiens
TGVPGLEAFH

SEQ ID NO: 1709 - protein, 10 aa, Homo Sapiens
FLLTGVPGLE

SEQ ID NO: 1710 - protein, 10 aa, Homo Sapiens
LHEPMYYFLS

SEQ ID NO: 1711 - protein, 10 aa, Homo Sapiens
SIIFLLTGVP

SEQ ID NO: 1712 - protein, 10 aa, Homo Sapiens
LILFATITQP

SEQ ID NO: 1713 - protein, 10 aa, Homo Sapiens
ATITQPSLHE

SEQ ID NO: 1714 - protein, 10 aa, Homo Sapiens
SLILFATITQ

SEQ ID NO: 1715 - protein, 10 aa, Homo Sapiens
PMYYFLSMLS

SEQ ID NO: 1716 - protein, 10 aa, Homo Sapiens
TITQPSLHEP

SEQ ID NO: 1717 - protein, 10 aa, Homo Sapiens
IIFLLTGVPG

SEQ ID NO: 1718 - protein, 10 aa, Homo Sapiens
FHTWISIPFC

SEQ ID NO: 1719 - protein, 10 aa, Homo Sapiens
STSIIFLLTG

SEQ ID NO: 1720 - protein, 10 aa, Homo Sapiens
EAFHTWISIP

SEQ ID NO: 1721 - protein, 10 aa, Homo Sapiens
FATITQPSLH

SEQ ID NO: 1722 - protein, 10 aa, Homo Sapiens
TYLLTSPLMN

SEQ ID NO: 1723 - protein, 10 aa, Homo Sapiens
ANTYLLTSPL

SEQ ID NO: 1724 - protein, 10 aa, Homo Sapiens
LTSPLMNPVI

SEQ ID NO: 1725 - protein, 10 aa, Homo Sapiens
NTYLLTSPLM

SEQ ID NO: 1726 - protein, 10 aa, Homo Sapiens
TMIANTYLLT

SEQ ID NO: 1727 - protein, 10 aa, Homo Sapiens
TSPLMNPVIY

SEQ ID NO: 1728 - protein, 10 aa, Homo Sapiens
LLTSPLMNPV

SEQ ID NO: 1729 - protein, 10 aa, Homo Sapiens
MIANTYLLTS

SEQ ID NO: 1730 - protein, 10 aa, Homo Sapiens
IANTYLLTSP

SEQ ID NO: 1731 - protein, 10 aa, Homo Sapiens
YLLTSPLMNP

SEQ ID NO: 1732 - protein, 9 aa, Homo Sapiens
NPLRYAMIL

SEQ ID NO: 1733 - protein, 9 aa, Homo Sapiens
TVMESSVLL

SEQ ID NO: 1734 - protein, 9 aa, Homo Sapiens
YVLIIRTVL

SEQ ID NO: 1735 - protein, 9 aa, Homo Sapiens
APAYVHTMI

SEQ ID NO: 1736 - protein, 9 aa, Homo Sapiens
SVIRGLLML

SEQ ID NO: 1737 - protein, 9 aa, Homo Sapiens
GVASVIRGL

SEQ ID NO: 1738 - protein, 9 aa, Homo Sapiens
VASVIRGLL

SEQ ID NO: 1739 - protein, 9 aa, Homo Sapiens
HTMIANTYL

SEQ ID NO: 1740 - protein, 9 aa, Homo Sapiens
LSMLSATDL

SEQ ID NO: 1741 - protein, 9 aa, Homo Sapiens
GVDLLLILL

SEQ ID NO: 1742 - protein, 9 aa, Homo Sapiens
LMLTPMVAL

SEQ ID NO: 1743 - protein, 9 aa, Homo Sapiens
NVREISFNA

SEQ ID NO: 1744 - protein, 9 aa, Homo Sapiens
LSYCHSQVL

SEQ ID NO: 1745 - protein, 9 aa, Homo Sapiens
SISTLVTML

SEQ ID NO: 1746 - protein, 9 aa, Homo Sapiens
LLILLSYVL

SEQ ID NO: 1747 - protein, 9 aa, Homo Sapiens
IRRAVIKIL

SEQ ID NO: 1748 - protein, 9 aa, Homo Sapiens
FSTVGVDLL

SEQ ID NO: 1749 - protein, 9 aa, Homo Sapiens
VGVDLLLIL

SEQ ID NO: 1750 - protein, 9 aa, Homo Sapiens
QIRRAVIKI

SEQ ID NO: 1751 - protein, 9 aa, Homo Sapiens
TMIANTYLL

SEQ ID NO: 1752 - protein, 9 aa, Homo Sapiens
NTYLLISPL

SEQ ID NO: 1753 - protein, 9 aa, Homo Sapiens
FTVMESSVL

SEQ ID NO: 1754 - protein, 9 aa, Homo Sapiens
IPLISLSIV

SEQ ID NO: 1755 - protein, 9 aa, Homo Sapiens
MLSATDLGL

SEQ ID NO: 1756 - protein, 9 aa, Homo Sapiens
STVGVDLLL

SEQ ID NO: 1757 - protein, 9 aa, Homo Sapiens
DLGLSISTL

SEQ ID NO: 1758 - protein, 9 aa, Homo Sapiens
MLTPMVALL

SEQ ID NO: 1759 - protein, 9 aa, Homo Sapiens
ASVIRGLLM

SEQ ID NO: 1760 - protein, 9 aa, Homo Sapiens
QAPAYVHTM

SEQ ID NO: 1761 - protein, 9 aa, Homo Sapiens
AVSNPLRYA

SEQ ID NO: 1762 - protein, 9 aa, Homo Sapiens
TVGVDLLLI

SEQ ID NO: 1763 - protein, 9 aa, Homo Sapiens
DSRIAQIGV

SEQ ID NO: 1764 - protein, 9 aa, Homo Sapiens
NPVIYSVKT

SEQ ID NO: 1765 - protein, 9 aa, Homo Sapiens
IVAFAIYYI

SEQ ID NO: 1766 - protein, 9 aa, Homo Sapiens
LAMAFDRFV

SEQ ID NO: 1767 - protein, 9 aa, Homo Sapiens
TAMFSTVGV

SEQ ID NO: 1768 - protein, 9 aa, Homo Sapiens
VSNPLRYAM

SEQ ID NO: 1769 - protein, 9 aa, Homo Sapiens
AFAIYYIPL

SEQ ID NO: 1770 - protein, 9 aa, Homo Sapiens
SATDLGLSI

SEQ ID NO: 1771 - protein, 9 aa, Homo Sapiens
AMILTDSRI

SEQ ID NO: 1772 - protein, 9 aa, Homo Sapiens
FAIYYIPLI

SEQ ID NO: 1773 - protein, 9 aa, Homo Sapiens
ACLSHMFFI

SEQ ID NO: 1774 - protein, 9 aa, Homo Sapiens
AQIGVASVI

SEQ ID NO: 1775 - protein, 9 aa, Homo Sapiens
RGLLMLTPM

SEQ ID NO: 1776 - protein, 9 aa, Homo Sapiens
IIRTVLSVA

SEQ ID NO: 1777 - protein, 9 aa, Homo Sapiens
VIRGLLMLT

SEQ ID NO: 1778 - protein, 9 aa, Homo Sapiens
LSISTLVTM

SEQ ID NO: 1779 - protein, 9 aa, Homo Sapiens
NSAVGLTAM

SEQ ID NO: 1780 - protein, 9 aa, Homo Sapiens
MAFDRFVAV

SEQ ID NO: 1781 - protein, 9 aa, Homo Sapiens
HPDVMKLSC

SEQ ID NO: 1782 - protein, 9 aa, Homo Sapiens
TPMVALLIR

SEQ ID NO: 1783 - protein, 9 aa, Homo Sapiens
IAQIGVASV

SEQ ID NO: 1784 - protein, 9 aa, Homo Sapiens
IYYIPLISL

SEQ ID NO: 1785 - protein, 9 aa, Homo Sapiens
YVHTMIANT

SEQ ID NO: 1786 - protein, 9 aa, Homo Sapiens
IVHRFGKQA

SEQ ID NO: 1787 - protein, 9 aa, Homo Sapiens
CVSHIVAFA

SEQ ID NO: 1788 - protein, 9 aa, Homo Sapiens
ASPEERKET

SEQ ID NO: 1789 - protein, 9 aa, Homo Sapiens
AMAFDRFVA

SEQ ID NO: 1790 - protein, 9 aa, Homo Sapiens
RFVAVSNPL

SEQ ID NO: 1791 - protein, 9 aa, Homo Sapiens
SNPLRYAMI

SEQ ID NO: 1792 - protein, 9 aa, Homo Sapiens
LTPMVALLI

SEQ ID NO: 1793 - protein, 9 aa, Homo Sapiens
CYHPDVMKL

SEQ ID NO: 1794 - protein, 9 aa, Homo Sapiens
REISFNACL

SEQ ID NO: 1795 - protein, 9 aa, Homo Sapiens
STLVTMLSI

SEQ ID NO: 1796 - protein, 9 aa, Homo Sapiens
MIANTYLLI

SEQ ID NO: 1797 - protein, 9 aa, Homo Sapiens
MFSTVGVDL

SEQ ID NO: 1798 - protein, 9 aa, Homo Sapiens
PMVALLIRL

SEQ ID NO: 1799 - protein, 9 aa, Homo Sapiens
KLSCTDTRI

SEQ ID NO: 1800 - protein, 9 aa, Homo Sapiens
VSHIVAFAI

SEQ ID NO: 1801 - protein, 9 aa, Homo Sapiens
YIPLISLSI

SEQ ID NO: 1802 - protein, 9 aa, Homo Sapiens
LILLSYVLI

SEQ ID NO: 1803 - protein, 9 aa, Homo Sapiens
TRINSAVGL

SEQ ID NO: 1804 - protein, 9 aa, Homo Sapiens
ISPLMNPVI

SEQ ID NO: 1805 - protein, 9 aa, Homo Sapiens
ILLSYVLII

SEQ ID NO: 1806 - protein, 9 aa, Homo Sapiens
SPLMNPVIY

SEQ ID NO: 1807 - protein, 9 aa, Homo Sapiens
KTKQIRRAV

SEQ ID NO: 1808 - protein, 9 aa, Homo Sapiens
ALLIRLSYC

SEQ ID NO: 1809 - protein, 9 aa, Homo Sapiens
AVGLTAMFS

SEQ ID NO: 1810 - protein, 9 aa, Homo Sapiens
LLMLTPMVA

SEQ ID NO: 1811 - protein, 9 aa, Homo Sapiens
LGLSISTLV

SEQ ID NO: 1812 - protein, 9 aa, Homo Sapiens
LIRLSYCHS

SEQ ID NO: 1813 - protein, 9 aa, Homo Sapiens
MLSIFWFNV

SEQ ID NO: 1814 - protein, 9 aa, Homo Sapiens
LIIRTVLSV

SEQ ID NO: 1815 - protein, 9 aa, Homo Sapiens
LLLILLSYV

SEQ ID NO: 1816 - protein, 9 aa, Homo Sapiens
FGKQAPAYV

SEQ ID NO: 1817 - protein, 9 aa, Homo Sapiens
GLLMLTPMV

SEQ ID NO: 1818 - protein, 9 aa, Homo Sapiens
FSTCVSHIV

SEQ ID NO: 1819 - protein, 9 aa, Homo Sapiens
RLSYCHSQV

SEQ ID NO: 1820 - protein, 9 aa, Homo Sapiens
LMNPVIYSV

SEQ ID NO: 1821 - protein, 9 aa, Homo Sapiens
GLTAMFSTV

SEQ ID NO: 1822 - protein, 9 aa, Homo Sapiens
LISPLMNPV

SEQ ID NO: 1823 - protein, 9 aa, Homo Sapiens
HSYCYHPDV

SEQ ID NO: 1824 - protein, 9 aa, Homo Sapiens
DVMKLSCTD

SEQ ID NO: 1825 - protein, 9 aa, Homo Sapiens
AVIKILHSK

SEQ ID NO: 1826 - protein, 9 aa, Homo Sapiens
SPEERKETF

SEQ ID NO: 1827 - protein, 9 aa, Homo Sapiens
LTDSRIAQI

SEQ ID NO: 1828 - protein, 9 aa, Homo Sapiens
MESSVLLAM

SEQ ID NO: 1829 - protein, 9 aa, Homo Sapiens
GLSISTLVT

SEQ ID NO: 1830 - protein, 9 aa, Homo Sapiens
LSYVLIIRT

SEQ ID NO: 1831 - protein, 9 aa, Homo Sapiens
SYCYHPDVM

SEQ ID NO: 1832 - protein, 9 aa, Homo Sapiens
EPMYYFLSM

SEQ ID NO: 1833 - protein, 9 aa, Homo Sapiens
FATITQPSL

SEQ ID NO: 1834 - protein, 9 aa, Homo Sapiens
ALLGNSLIL

SEQ ID NO: 1835 - protein, 9 aa, Homo Sapiens
WISIPFCFL

SEQ ID NO: 1836 - protein, 9 aa, Homo Sapiens
FLLTGVPGL

SEQ ID NO: 1837 - protein, 9 aa, Homo Sapiens
TSTSIIFLL

SEQ ID NO: 1838 - protein, 9 aa, Homo Sapiens
VTALLGNSL

SEQ ID NO: 1839 - protein, 9 aa, Homo Sapiens
FCFLSVTAL

SEQ ID NO: 1840 - protein, 9 aa, Homo Sapiens
ITSTSIIFL

SEQ ID NO: 1841 - protein, 9 aa, Homo Sapiens
VPGLEAFHT

SEQ ID NO: 1842 - protein, 9 aa, Homo Sapiens
IPFCFLSVT

SEQ ID NO: 1843 - protein, 9 aa, Homo Sapiens
EAFHTWISI

SEQ ID NO: 1844 - protein, 9 aa, Homo Sapiens
TALLGNSLI

SEQ ID NO: 1845 - protein, 9 aa, Homo Sapiens
TQPSLHEPM

SEQ ID NO: 1846 - protein, 9 aa, Homo Sapiens
CFLSVTALL

SEQ ID NO: 1847 - protein, 9 aa, Homo Sapiens
QNITSTSII

SEQ ID NO: 1848 - protein, 9 aa, Homo Sapiens
FITSTLQNI

SEQ ID NO: 1849 - protein, 9 aa, Homo Sapiens
NSLILFATI

SEQ ID NO: 1850 - protein, 9 aa, Homo Sapiens
QPSLHEPMY

SEQ ID NO: 1851 - protein, 9 aa, Homo Sapiens
LQNITSTSI

SEQ ID NO: 1852 - protein, 9 aa, Homo Sapiens
PMYYFLSML

SEQ ID NO: 1853 - protein, 9 aa, Homo Sapiens
SIIFLLTGV

SEQ ID NO: 1854 - protein, 9 aa, Homo Sapiens
SIPFCFLSV

SEQ ID NO: 1855 - protein, 9 aa, Homo Sapiens
LTGVPGLEA

SEQ ID NO: 1856 - protein, 9 aa, Homo Sapiens
LHEPMYYFL

SEQ ID NO: 1857 - protein, 9 aa, Homo Sapiens
GLEAFHTWI

SEQ ID NO: 1858 - protein, 9 aa, Homo Sapiens
GNSLILFAT

SEQ ID NO: 1859 - protein, 9 aa, Homo Sapiens
SLILFATIT

SEQ ID NO: 1860 - protein, 9 aa, Homo Sapiens
LGNSLILFA

SEQ ID NO: 1861 - protein, 9 aa, Homo Sapiens
STLQNITST

SEQ ID NO: 1862 - protein, 9 aa, Homo Sapiens
STSIIFLLT

SEQ ID NO: 1863 - protein, 9 aa, Homo Sapiens
ITSTLQNIT

SEQ ID NO: 1864 - protein, 9 aa, Homo Sapiens
SVTALLGNS

SEQ ID NO: 1865 - protein, 9 aa, Homo Sapiens
HTWISIPFC

SEQ ID NO: 1866 - protein, 9 aa, Homo Sapiens
GVPGLEAFH

SEQ ID NO: 1867 - protein, 9 aa, Homo Sapiens
SLHEPMYYF

SEQ ID NO: 1868 - protein, 9 aa, Homo Sapiens
ATITQPSLH

SEQ ID NO: 1869 - protein, 9 aa, Homo Sapiens
LSVTALLGN

SEQ ID NO: 1870 - protein, 9 aa, Homo Sapiens
TLQNITSTS

SEQ ID NO: 1871 - protein, 9 aa, Homo Sapiens
LLGNSLILF

SEQ ID NO: 1872 - protein, 9 aa, Homo Sapiens
ISIPFCFLS

SEQ ID NO: 1873 - protein, 9 aa, Homo Sapiens
TGVPGLEAF

SEQ ID NO: 1874 - protein, 9 aa, Homo Sapiens
TSTLQNITS

SEQ ID NO: 1875 - protein, 9 aa, Homo Sapiens
NITSTSIIF

SEQ ID NO: 1876 - protein, 9 aa, Homo Sapiens
TITQPSLHE

SEQ ID NO: 1877 - protein, 9 aa, Homo Sapiens
ITQPSLHEP

SEQ ID NO: 1878 - protein, 9 aa, Homo Sapiens
IIFLLTGVP

SEQ ID NO: 1879 - protein, 9 aa, Homo Sapiens
FLSVTALLG

SEQ ID NO: 1880 - protein, 9 aa, Homo Sapiens
ILFATITQP

SEQ ID NO: 1881 - protein, 9 aa, Homo Sapiens
LILFATITQ

SEQ ID NO: 1882 - protein, 9 aa, Homo Sapiens
TSIIFLLTG

SEQ ID NO: 1883 - protein, 9 aa, Homo Sapiens
LLTGVPGLE

SEQ ID NO: 1884 - protein, 9 aa, Homo Sapiens
AFHTWISIP

SEQ ID NO: 1885 - protein, 9 aa, Homo Sapiens
TWISIPFCF

SEQ ID NO: 1886 - protein, 9 aa, Homo Sapiens
LFATITQPS

SEQ ID NO: 1887 - protein, 9 aa, Homo Sapiens
FHTWISIPF

SEQ ID NO: 1888 - protein, 9 aa, Homo Sapiens
PGLEAFHTW

SEQ ID NO: 1889 - protein, 9 aa, Homo Sapiens
LEAFHTWIS

SEQ ID NO: 1890 - protein, 9 aa, Homo Sapiens
HEPMYYFLS

SEQ ID NO: 1891 - protein, 9 aa, Homo Sapiens
PSLHEPMYY

SEQ ID NO: 1892 - protein, 9 aa, Homo Sapiens
IFLLTGVPG

SEQ ID NO: 1893 - protein, 9 aa, Homo Sapiens
PFCFLSVTA

SEQ ID NO: 1894 - protein, 9 aa, Homo Sapiens
NTYLLTSPL

SEQ ID NO: 1895 - protein, 9 aa, Homo Sapiens
TSPLMNPVI

SEQ ID NO: 1896 - protein, 9 aa, Homo Sapiens
LTSPLMNPV

SEQ ID NO: 1897 - protein, 9 aa, Homo Sapiens
TYLLTSPLM

SEQ ID NO: 1898 - protein, 9 aa, Homo Sapiens
MIANTYLLT

SEQ ID NO: 1899 - protein, 9 aa, Homo Sapiens
IANTYLLTS

SEQ ID NO: 1900 - protein, 9 aa, Homo Sapiens
ANTYLLTSP

SEQ ID NO: 1901 - protein, 9 aa, Homo Sapiens
YLLTSPLMN

SEQ ID NO: 1902 - protein, 9 aa, Homo Sapiens
LLTSPLMNP

SEQ ID NO: 1903 - protein, 10 aa, Homo Sapiens
TPMVALLIRL

SEQ ID NO: 1904 - protein, 10 aa, Homo Sapiens
DTRINSAVGL

SEQ ID NO: 1905 - protein, 10 aa, Homo Sapiens
QIRRAVIKIL

SEQ ID NO: 1906 - protein, 10 aa, Homo Sapiens
GVASVIRGLL

SEQ ID NO: 1907 - protein, 10 aa, Homo Sapiens
AVSNPLRYAM

SEQ ID NO: 1908 - protein, 10 aa, Homo Sapiens
TVGVDLLLIL

SEQ ID NO: 1909 - protein, 10 aa, Homo Sapiens
AIYYIPLISL

SEQ ID NO: 1910 - protein, 10 aa, Homo Sapiens
LLMLTPMVAL

SEQ ID NO: 1911 - protein, 10 aa, Homo Sapiens
ANTYLLISPL

SEQ ID NO: 1912 - protein, 10 aa, Homo Sapiens
AMFSTVGVDL

SEQ ID NO: 1913 - protein, 10 aa, Homo Sapiens
ASVIRGLLML

SEQ ID NO: 1914 - protein, 10 aa, Homo Sapiens
HTMIANTYLL

SEQ ID NO: 1915 - protein, 10 aa, Homo Sapiens
VAFAIYYIPL

SEQ ID NO: 1916 - protein, 10 aa, Homo Sapiens
APAYVHTMIA

SEQ ID NO: 1917 - protein, 10 aa, Homo Sapiens
NVREISFNAC

SEQ ID NO: 1918 - protein, 10 aa, Homo Sapiens
IGVASVIRGL

SEQ ID NO: 1919 - protein, 10 aa, Homo Sapiens
RLSYCHSQVL

SEQ ID NO: 1920 - protein, 10 aa, Homo Sapiens
VGVDLLLILL

SEQ ID NO: 1921 - protein, 10 aa, Homo Sapiens
FSTVGVDLLL

SEQ ID NO: 1922 - protein, 10 aa, Homo Sapiens
SNPLRYAMIL

SEQ ID NO: 1923 - protein, 10 aa, Homo Sapiens
LMLTPMVALL

SEQ ID NO: 1924 - protein, 10 aa, Homo Sapiens
FTVMESSVLL

SEQ ID NO: 1925 - protein, 10 aa, Homo Sapiens
SMLSATDLGL

SEQ ID NO: 1926 - protein, 10 aa, Homo Sapiens
FLSMLSATDL

SEQ ID NO: 1927 - protein, 10 aa, Homo Sapiens
YCYHPDVMKL

SEQ ID NO: 1928 - protein, 10 aa, Homo Sapiens
LSISTLVTML

SEQ ID NO: 1929 - protein, 10 aa, Homo Sapiens
LLLILLSYVL

SEQ ID NO: 1930 - protein, 10 aa, Homo Sapiens
YAMILTDSRI

SEQ ID NO: 1931 - protein, 10 aa, Homo Sapiens
VASVIRGLLM

SEQ ID NO: 1932 - protein, 10 aa, Homo Sapiens
CVSHIVAFAI

SEQ ID NO: 1933 - protein, 10 aa, Homo Sapiens
NPLRYAMILT

SEQ ID NO: 1934 - protein, 10 aa, Homo Sapiens
AVGLTAMFST

SEQ ID NO: 1935 - protein, 10 aa, Homo Sapiens
DVMKLSCTDT

SEQ ID NO: 1936 - protein, 10 aa, Homo Sapiens
TVMESSVLLA

SEQ ID NO: 1937 - protein, 10 aa, Homo Sapiens
LAMAFDRFVA

SEQ ID NO: 1938 - protein, 10 aa, Homo Sapiens
QAPAYVHTMI

SEQ ID NO: 1939 - protein, 10 aa, Homo Sapiens
NACLSHMFFI

SEQ ID NO: 1940 - protein, 10 aa, Homo Sapiens
IAQIGVASVI

SEQ ID NO: 1941 - protein, 10 aa, Homo Sapiens
DSRIAQIGVA

SEQ ID NO: 1942 - protein, 10 aa, Homo Sapiens
NTYLLISPLM

SEQ ID NO: 1943 - protein, 10 aa, Homo Sapiens
ISFNACLSHM

SEQ ID NO: 1944 - protein, 10 aa, Homo Sapiens
HSYCYHPDVM

SEQ ID NO: 1945 - protein, 10 aa, Homo Sapiens
INSAVGLTAM

SEQ ID NO: 1946 - protein, 10 aa, Homo Sapiens
KQAPAYVHTM

SEQ ID NO: 1947 - protein, 10 aa, Homo Sapiens
GLSISTLVTM

SEQ ID NO: 1948 - protein, 10 aa, Homo Sapiens
AMAFDRFVAV

SEQ ID NO: 1949 - protein, 10 aa, Homo Sapiens
KTKQIRRAVI

SEQ ID NO: 1950 - protein, 10 aa, Homo Sapiens
SPLMNPVIYS

SEQ ID NO: 1951 - protein, 10 aa, Homo Sapiens
HPDVMKLSCT

SEQ ID NO: 1952 - protein, 10 aa, Homo Sapiens
SYVLIIRTVL

SEQ ID NO: 1953 - protein, 10 aa, Homo Sapiens
SVIRGLLMLT

SEQ ID NO: 1954 - protein, 10 aa, Homo Sapiens
SVKTKQIRRA

SEQ ID NO: 1955 - protein, 10 aa, Homo Sapiens
VAVSNPLRYA

SEQ ID NO: 1956 - protein, 10 aa, Homo Sapiens
VASPEERKET

SEQ ID NO: 1957 - protein, 10 aa, Homo Sapiens
LISPLMNPVI

SEQ ID NO: 1958 - protein, 10 aa, Homo Sapiens
FFTVMESSVL

SEQ ID NO: 1959 - protein, 10 aa, Homo Sapiens
VHTMIANTYL

SEQ ID NO: 1960 - protein, 10 aa, Homo Sapiens
LLILLSYVLI

SEQ ID NO: 1961 - protein, 10 aa, Homo Sapiens
SIFWFNVREI

SEQ ID NO: 1962 - protein, 10 aa, Homo Sapiens
LSATDLGLSI

SEQ ID NO: 1963 - protein, 10 aa, Homo Sapiens
VIYSVKTKQI

SEQ ID NO: 1964 - protein, 10 aa, Homo Sapiens
TDLGLSISTL

SEQ ID NO: 1965 - protein, 10 aa, Homo Sapiens
MLTPMVALLI

SEQ ID NO: 1966 - protein, 10 aa, Homo Sapiens
ISTLVTMLSI

SEQ ID NO: 1967 - protein, 10 aa, Homo Sapiens
HIVAFAIYYI

SEQ ID NO: 1968 - protein, 10 aa, Homo Sapiens
KQIRRAVIKI

SEQ ID NO: 1969 - protein, 10 aa, Homo Sapiens
TMIANTYLLI

SEQ ID NO: 1970 - protein, 10 aa, Homo Sapiens
MFSTVGVDLL

SEQ ID NO: 1971 - protein, 10 aa, Homo Sapiens
VSNPLRYAMI

SEQ ID NO: 1972 - protein, 10 aa, Homo Sapiens
ILTDSRIAQI

SEQ ID NO: 1973 - protein, 10 aa, Homo Sapiens
STVGVDLLLI

SEQ ID NO: 1974 - protein, 10 aa, Homo Sapiens
DRFVAVSNPL

SEQ ID NO: 1975 - protein, 10 aa, Homo Sapiens
LILLSYVLII

SEQ ID NO: 1976 - protein, 10 aa, Homo Sapiens
ETFSTCVSHI

SEQ ID NO: 1977 - protein, 10 aa, Homo Sapiens
AMILTDSRIA

SEQ ID NO: 1978 - protein, 10 aa, Homo Sapiens
VMESSVLLAM

SEQ ID NO: 1979 - protein, 10 aa, Homo Sapiens
VALLIRLSYC

SEQ ID NO: 1980 - protein, 10 aa, Homo Sapiens
LLISPLMNPV

SEQ ID NO: 1981 - protein, 10 aa, Homo Sapiens
IPLISLSIVH

SEQ ID NO: 1982 - protein, 10 aa, Homo Sapiens
VLIIRTVLSV

SEQ ID NO: 1983 - protein, 10 aa, Homo Sapiens
LTAMFSTVGV

SEQ ID NO: 1984 - protein, 10 aa, Homo Sapiens
YIPLISLSIV

SEQ ID NO: 1985 - protein, 10 aa, Homo Sapiens
NPVIYSVKTK

SEQ ID NO: 1986 - protein, 10 aa, Homo Sapiens
RGLLMLTPMV

SEQ ID NO: 1987 - protein, 10 aa, Homo Sapiens
LLAMAFDRFV

SEQ ID NO: 1988 - protein, 10 aa, Homo Sapiens
DLLLILLSYV

SEQ ID NO: 1989 - protein, 10 aa, Homo Sapiens
VGLTAMFSTV

SEQ ID NO: 1990 - protein, 10 aa, Homo Sapiens
LSYVLIIRTV

SEQ ID NO: 1991 - protein, 10 aa, Homo Sapiens
HMFFIKFFTV

SEQ ID NO: 1992 - protein, 10 aa, Homo Sapiens
RIAQIGVASV

SEQ ID NO: 1993 - protein, 10 aa, Homo Sapiens
IIRTVLSVAS

SEQ ID NO: 1994 - protein, 10 aa, Homo Sapiens
TMLSIFWFNV

SEQ ID NO: 1995 - protein, 10 aa, Homo Sapiens
DLGLSISTLV

SEQ ID NO: 1996 - protein, 10 aa, Homo Sapiens
MVALLIRLSY

SEQ ID NO: 1997 - protein, 10 aa, Homo Sapiens
AVIKILHSKE

SEQ ID NO: 1998 - protein, 10 aa, Homo Sapiens
SPEERKETFS

SEQ ID NO: 1999 - protein, 10 aa, Homo Sapiens
AFAIYYIPLI

SEQ ID NO: 2000 - protein, 10 aa, Homo Sapiens
VREISFNACL

SEQ ID NO: 2001 - protein, 10 aa, Homo Sapiens
IRGLLMLTPM

SEQ ID NO: 2002 - protein, 10 aa, Homo Sapiens
YVLIIRTVLS

SEQ ID NO: 2003 - protein, 10 aa, Homo Sapiens
EPMYYFLSML

SEQ ID NO: 2004 - protein, 10 aa, Homo Sapiens
SVTALLGNSL

SEQ ID NO: 2005 - protein, 10 aa, Homo Sapiens
TALLGNSLIL

SEQ ID NO: 2006 - protein, 10 aa, Homo Sapiens
FCFLSVTALL

SEQ ID NO: 2007 - protein, 10 aa, Homo Sapiens
SLHEPMYYFL

SEQ ID NO: 2008 - protein, 10 aa, Homo Sapiens
ITSTSIIFLL

SEQ ID NO: 2009 - protein, 10 aa, Homo Sapiens
NITSTSIIFL

SEQ ID NO: 2010 - protein, 10 aa, Homo Sapiens
IPFCFLSVTA

SEQ ID NO: 2011 - protein, 10 aa, Homo Sapiens
ITQPSLHEPM

SEQ ID NO: 2012 - protein, 10 aa, Homo Sapiens
TWISIPFCFL

SEQ ID NO: 2013 - protein, 10 aa, Homo Sapiens
GVPGLEAFHT

SEQ ID NO: 2014 - protein, 10 aa, Homo Sapiens
LFATITQPSL

SEQ ID NO: 2015 - protein, 10 aa, Homo Sapiens
QPSLHEPMYY

SEQ ID NO: 2016 - protein, 10 aa, Homo Sapiens
VTALLGNSLI

SEQ ID NO: 2017 - protein, 10 aa, Homo Sapiens
LQNITSTSII

SEQ ID NO: 2018 - protein, 10 aa, Homo Sapiens
GNSLILFATI

SEQ ID NO: 2019 - protein, 10 aa, Homo Sapiens
IFLLTGVPGL

SEQ ID NO: 2020 - protein, 10 aa, Homo Sapiens
TLQNITSTSI

SEQ ID NO: 2021 - protein, 10 aa, Homo Sapiens
VPGLEAFHTW

SEQ ID NO: 2022 - protein, 10 aa, Homo Sapiens
ISIPFCFLSV

SEQ ID NO: 2023 - protein, 10 aa, Homo Sapiens
TSIIFLLTGV

SEQ ID NO: 2024 - protein, 10 aa, Homo Sapiens
LLTGVPGLEA

SEQ ID NO: 2025 - protein, 10 aa, Homo Sapiens
LGNSLILFAT

SEQ ID NO: 2026 - protein, 10 aa, Homo Sapiens
SIPFCFLSVT

SEQ ID NO: 2027 - protein, 10 aa, Homo Sapiens
TSTSIIFLLT

SEQ ID NO: 2028 - protein, 10 aa, Homo Sapiens
TSTLQNITST

SEQ ID NO: 2029 - protein, 10 aa, Homo Sapiens
LLGNSLILFA

SEQ ID NO: 2030 - protein, 10 aa, Homo Sapiens
HEPMYYFLSM

SEQ ID NO: 2031 - protein, 10 aa, Homo Sapiens
NSLILFATIT

SEQ ID NO: 2032 - protein, 10 aa, Homo Sapiens
FITSTLQNIT

SEQ ID NO: 2033 - protein, 10 aa, Homo Sapiens
ALLGNSLILF

SEQ ID NO: 2034 - protein, 10 aa, Homo Sapiens
ATITQPSLHE

SEQ ID NO: 2035 - protein, 10 aa, Homo Sapiens
PFCFLSVTAL

SEQ ID NO: 2036 - protein, 10 aa, Homo Sapiens
PGLEAFHTWI

SEQ ID NO: 2037 - protein, 10 aa, Homo Sapiens
LEAFHTWISI

SEQ ID NO: 2038 - protein, 10 aa, Homo Sapiens
FATITQPSLH

SEQ ID NO: 2039 - protein, 10 aa, Homo Sapiens
EAFHTWISIP

SEQ ID NO: 2040 - protein, 10 aa, Homo Sapiens
LTGVPGLEAF

SEQ ID NO: 2041 - protein, 10 aa, Homo Sapiens
WISIPFCFLS

SEQ ID NO: 2042 - protein, 10 aa, Homo Sapiens
FLSVTALLGN

SEQ ID NO: 2043 - protein, 10 aa, Homo Sapiens
LSVTALLGNS

SEQ ID NO: 2044 - protein, 10 aa, Homo Sapiens
ILFATITQPS

SEQ ID NO: 2045 - protein, 10 aa, Homo Sapiens
STLQNITSTS

SEQ ID NO: 2046 - protein, 10 aa, Homo Sapiens
HTWISIPFCF

SEQ ID NO: 2047 - protein, 10 aa, Homo Sapiens
QNITSTSIIF

SEQ ID NO: 2048 - protein, 10 aa, Homo Sapiens
ITSTLQNITS

SEQ ID NO: 2049 - protein, 10 aa, Homo Sapiens
TQPSLHEPMY

SEQ ID NO: 2050 - protein, 10 aa, Homo Sapiens
TGVPGLEAFH

SEQ ID NO: 2051 - protein, 10 aa, Homo Sapiens
LILFATITQP

SEQ ID NO: 2052 - protein, 10 aa, Homo Sapiens
TITQPSLHEP

SEQ ID NO: 2053 - protein, 10 aa, Homo Sapiens
IIFLLTGVPG

SEQ ID NO: 2054 - protein, 10 aa, Homo Sapiens
SIIFLLTGVP

SEQ ID NO: 2055 - protein, 10 aa, Homo Sapiens
SLILFATITQ

SEQ ID NO: 2056 - protein, 10 aa, Homo Sapiens
STSIIFLLTG

SEQ ID NO: 2057 - protein, 10 aa, Homo Sapiens
FLLTGVPGLE

SEQ ID NO: 2058 - protein, 10 aa, Homo Sapiens
FHTWISIPFC

SEQ ID NO: 2059 - protein, 10 aa, Homo Sapiens
AFHTWISIPF

SEQ ID NO: 2060 - protein, 10 aa, Homo Sapiens
GLEAFHTWIS

SEQ ID NO: 2061 - protein, 10 aa, Homo Sapiens
PSLHEPMYYF

SEQ ID NO: 2062 - protein, 10 aa, Homo Sapiens
PMYYFLSMLS

SEQ ID NO: 2063 - protein, 10 aa, Homo Sapiens
CFLSVTALLG

SEQ ID NO: 2064 - protein, 10 aa, Homo Sapiens
LHEPMYYFLS

SEQ ID NO: 2065 - protein, 10 aa, Homo Sapiens
ANTYLLTSPL

SEQ ID NO: 2066 - protein, 10 aa, Homo Sapiens
NTYLLTSPLM

SEQ ID NO: 2067 - protein, 10 aa, Homo Sapiens
LTSPLMNPVI

SEQ ID NO: 2068 - protein, 10 aa, Homo Sapiens
LLTSPLMNPV

SEQ ID NO: 2069 - protein, 10 aa, Homo Sapiens
TMIANTYLLT

SEQ ID NO: 2070 - protein, 10 aa, Homo Sapiens
IANTYLLTSP

SEQ ID NO: 2071 - protein, 10 aa, Homo Sapiens
TSPLMNPVIY

SEQ ID NO: 2072 - protein, 10 aa, Homo Sapiens
MIANTYLLTS

SEQ ID NO: 2073 - protein, 10 aa, Homo Sapiens
YLLTSPLMNP

SEQ ID NO: 2074 - protein, 10 aa, Homo Sapiens
TYLLTSPLMN

SEQ ID NO: 2075 - protein, 9 aa, Homo Sapiens
SPLMNPVIY

SEQ ID NO: 2076 - protein, 9 aa, Homo Sapiens
NPLRYAMIL

SEQ ID NO: 2077 - protein, 9 aa, Homo Sapiens
SPEERKETF

SEQ ID NO: 2078 - protein, 9 aa, Homo Sapiens
VSNPLRYAM

SEQ ID NO: 2079 - protein, 9 aa, Homo Sapiens
ASVIRGLLM

SEQ ID NO: 2080 - protein, 9 aa, Homo Sapiens
NSAVGLTAM

SEQ ID NO: 2081 - protein, 9 aa, Homo Sapiens
HSQVLHHSY

SEQ ID NO: 2082 - protein, 9 aa, Homo Sapiens
LSISTLVTM

SEQ ID NO: 2083 - protein, 9 aa, Homo Sapiens
APAYVHTMI

SEQ ID NO: 2084 - protein, 9 aa, Homo Sapiens
QAPAYVHTM

SEQ ID NO: 2085 - protein, 9 aa, Homo Sapiens
VALLIRLSY

SEQ ID NO: 2086 - protein, 9 aa, Homo Sapiens
VAVSNPLRY

SEQ ID NO: 2087 - protein, 9 aa, Homo Sapiens
FSTVGVDLL

SEQ ID NO: 2088 - protein, 9 aa, Homo Sapiens
LSMLSATDL

SEQ ID NO: 2089 - protein, 9 aa, Homo Sapiens
SSVLLAMAF

SEQ ID NO: 2090 - protein, 9 aa, Homo Sapiens
LSHMFFIKF

SEQ ID NO: 2091 - protein, 9 aa, Homo Sapiens
LSYCHSQVL

SEQ ID NO: 2092 - protein, 9 aa, Homo Sapiens
ISLSIVHRF

SEQ ID NO: 2093 - protein, 9 aa, Homo Sapiens
IPLISLSIV

SEQ ID NO: 2094 - protein, 9 aa, Homo Sapiens
RGLLMLTPM

SEQ ID NO: 2095 - protein, 9 aa, Homo Sapiens
DSRIAQIGV

SEQ ID NO: 2096 - protein, 9 aa, Homo Sapiens
VASVIRGLL

SEQ ID NO: 2097 - protein, 9 aa, Homo Sapiens
NACLSHMFF

SEQ ID NO: 2098 - protein, 9 aa, Homo Sapiens
SAVGLTAMF

SEQ ID NO: 2099 - protein, 9 aa, Homo Sapiens
SATDLGLSI

SEQ ID NO: 2100 - protein, 9 aa, Homo Sapiens
HIVAFAIYY

SEQ ID NO: 2101 - protein, 9 aa, Homo Sapiens
ISPLMNPVI

SEQ ID NO: 2102 - protein, 9 aa, Homo Sapiens
TVMESSVLL

SEQ ID NO: 2103 - protein, 9 aa, Homo Sapiens
NPVIYSVKT

SEQ ID NO: 2104 - protein, 9 aa, Homo Sapiens
DLLLILLSY

SEQ ID NO: 2105 - protein, 9 aa, Homo Sapiens
QVLHHSYCY

SEQ ID NO: 2106 - protein, 9 aa, Homo Sapiens
VGVDLLLIL

SEQ ID NO: 2107 - protein, 9 aa, Homo Sapiens
VSHIVAFAI

SEQ ID NO: 2108 - protein, 9 aa, Homo Sapiens
FTVMESSVL

SEQ ID NO: 2109 - protein, 9 aa, Homo Sapiens
ASPEERKET

SEQ ID NO: 2110 - protein, 9 aa, Homo Sapiens
MAFDRFVAV

SEQ ID NO: 2111 - protein, 9 aa, Homo Sapiens
KTKQIRRAV

SEQ ID NO: 2112 - protein, 9 aa, Homo Sapiens
QIRRAVIKI

SEQ ID NO: 2113 - protein, 9 aa, Homo Sapiens
FAIYYIPLI

SEQ ID NO: 2114 - protein, 9 aa, Homo Sapiens
HSYCYHPDV

SEQ ID NO: 2115 - protein, 9 aa, Homo Sapiens
TLVTMLSIF

SEQ ID NO: 2116 - protein, 9 aa, Homo Sapiens
LLAMAFDRF

SEQ ID NO: 2117 - protein, 9 aa, Homo Sapiens
FNACLSHMF

SEQ ID NO: 2118 - protein, 9 aa, Homo Sapiens
SISTLVTML

SEQ ID NO: 2119 - protein, 9 aa, Homo Sapiens
TMIANTYLL

SEQ ID NO: 2120 - protein, 9 aa, Homo Sapiens
DLGLSISTL

SEQ ID NO: 2121 - protein, 9 aa, Homo Sapiens
TCVSHIVAF

SEQ ID NO: 2122 - protein, 9 aa, Homo Sapiens
GVASVIRGL

SEQ ID NO: 2123 - protein, 9 aa, Homo Sapiens
NTYLLISPL

SEQ ID NO: 2124 - protein, 9 aa, Homo Sapiens
LLILLSYVL

SEQ ID NO: 2125 - protein, 9 aa, Homo Sapiens
MLSATDLGL

SEQ ID NO: 2126 - protein, 9 aa, Homo Sapiens
HTMIANTYL

SEQ ID NO: 2127 - protein, 9 aa, Homo Sapiens
LMLTPMVAL

SEQ ID NO: 2128 - protein, 9 aa, Homo Sapiens
MLTPMVALL

SEQ ID NO: 2129 - protein, 9 aa, Homo Sapiens
YVLIIRTVL

SEQ ID NO: 2130 - protein, 9 aa, Homo Sapiens
SVIRGLLML

SEQ ID NO: 2131 - protein, 9 aa, Homo Sapiens
FSTCVSHIV

SEQ ID NO: 2132 - protein, 9 aa, Homo Sapiens
VTMLSIFWF

SEQ ID NO: 2133 - protein, 9 aa, Homo Sapiens
STVGVDLLL

SEQ ID NO: 2134 - protein, 9 aa, Homo Sapiens
KLSCTDTRI

SEQ ID NO: 2135 - protein, 9 aa, Homo Sapiens
LSCTDTRIN

SEQ ID NO: 2136 - protein, 9 aa, Homo Sapiens
LSATDLGLS

SEQ ID NO: 2137 - protein, 9 aa, Homo Sapiens
IAQIGVASV

SEQ ID NO: 2138 - protein, 9 aa, Homo Sapiens
FGKQAPAYV

SEQ ID NO: 2139 - protein, 9 aa, Homo Sapiens
RAVIKILHS

SEQ ID NO: 2140 - protein, 9 aa, Homo Sapiens
TVGVDLLLI

SEQ ID NO: 2141 - protein, 9 aa, Homo Sapiens
NVREISFNA

SEQ ID NO: 2142 - protein, 9 aa, Homo Sapiens
HPDVMKLSC

SEQ ID NO: 2143 - protein, 9 aa, Homo Sapiens
TAMFSTVGV

SEQ ID NO: 2144 - protein, 9 aa, Homo Sapiens
LAMAFDRFV

SEQ ID NO: 2145 - protein, 9 aa, Homo Sapiens
ESSVLLAMA

SEQ ID NO: 2146 - protein, 9 aa, Homo Sapiens
ISTLVTMLS

SEQ ID NO: 2147 - protein, 9 aa, Homo Sapiens
LVTMLSIFW

SEQ ID NO: 2148 - protein, 9 aa, Homo Sapiens
LSYVLIIRT

SEQ ID NO: 2149 - protein, 9 aa, Homo Sapiens
LTPMVALLI

SEQ ID NO: 2150 - protein, 9 aa, Homo Sapiens
RLSYCHSQV

SEQ ID NO: 2151 - protein, 9 aa, Homo Sapiens
MIANTYLLI

SEQ ID NO: 2152 - protein, 9 aa, Homo Sapiens
IVAFAIYYI

SEQ ID NO: 2153 - protein, 9 aa, Homo Sapiens
LILLSYVLI

SEQ ID NO: 2154 - protein, 9 aa, Homo Sapiens
ACLSHMFFI

SEQ ID NO: 2155 - protein, 9 aa, Homo Sapiens
RFGKQAPAY

SEQ ID NO: 2156 - protein, 9 aa, Homo Sapiens
ILLSYVLII

SEQ ID NO: 2157 - protein, 9 aa, Homo Sapiens
STLVTMLSI

SEQ ID NO: 2158 - protein, 9 aa, Homo Sapiens
AMILTDSRI

SEQ ID NO: 2159 - protein, 9 aa, Homo Sapiens
AQIGVASVI

SEQ ID NO: 2160 - protein, 9 aa, Homo Sapiens
YIPLISLSI

SEQ ID NO: 2161 - protein, 9 aa, Homo Sapiens
SNPLRYAMI

SEQ ID NO: 2162 - protein, 9 aa, Homo Sapiens
VMKLSCTDT

SEQ ID NO: 2163 - protein, 9 aa, Homo Sapiens
GVDLLLILL

SEQ ID NO: 2164 - protein, 9 aa, Homo Sapiens
IIRTVLSVA

SEQ ID NO: 2165 - protein, 9 aa, Homo Sapiens
VIRGLLMLT

SEQ ID NO: 2166 - protein, 9 aa, Homo Sapiens
LIRLSYCHS

SEQ ID NO: 2167 - protein, 9 aa, Homo Sapiens
IRRAVIKIL

SEQ ID NO: 2168 - protein, 9 aa, Homo Sapiens
IANTYLLIS

SEQ ID NO: 2169 - protein, 9 aa, Homo Sapiens
SYCYHPDVM

SEQ ID NO: 2170 - protein, 9 aa, Homo Sapiens
LMNPVIYSV

SEQ ID NO: 2171 - protein, 9 aa, Homo Sapiens
REISFNACL

SEQ ID NO: 2172 - protein, 9 aa, Homo Sapiens
GLTAMFSTV

SEQ ID NO: 2173 - protein, 9 aa, Homo Sapiens
LIIRTVLSV

SEQ ID NO: 2174 - protein, 9 aa, Homo Sapiens
MESSVLLAM

SEQ ID NO: 2175 - protein, 9 aa, Homo Sapiens
EPMYYFLSM

SEQ ID NO: 2176 - protein, 9 aa, Homo Sapiens
QPSLHEPMY

SEQ ID NO: 2177 - protein, 9 aa, Homo Sapiens
TSTSIIFLL

SEQ ID NO: 2178 - protein, 9 aa, Homo Sapiens
VPGLEAFHT

SEQ ID NO: 2179 - protein, 9 aa, Homo Sapiens
FATITQPSL

SEQ ID NO: 2180 - protein, 9 aa, Homo Sapiens
NSLILFATI

SEQ ID NO: 2181 - protein, 9 aa, Homo Sapiens
SLHEPMYYF

SEQ ID NO: 2182 - protein, 9 aa, Homo Sapiens
IPFCFLSVT

SEQ ID NO: 2183 - protein, 9 aa, Homo Sapiens
TQPSLHEPM

SEQ ID NO: 2184 - protein, 9 aa, Homo Sapiens
PSLHEPMYY

SEQ ID NO: 2185 - protein, 9 aa, Homo Sapiens
TALLGNSLI

SEQ ID NO: 2186 - protein, 9 aa, Homo Sapiens
EAFHTWISI

SEQ ID NO: 2187 - protein, 9 aa, Homo Sapiens
WISIPFCFL

SEQ ID NO: 2188 - protein, 9 aa, Homo Sapiens
LLGNSLILF

SEQ ID NO: 2189 - protein, 9 aa, Homo Sapiens
FLLTGVPGL

SEQ ID NO: 2190 - protein, 9 aa, Homo Sapiens
TGVPGLEAF

SEQ ID NO: 2191 - protein, 9 aa, Homo Sapiens
NITSTSIIF

SEQ ID NO: 2192 - protein, 9 aa, Homo Sapiens
FCFLSVTAL

SEQ ID NO: 2193 - protein, 9 aa, Homo Sapiens
ALLGNSLIL

SEQ ID NO: 2194 - protein, 9 aa, Homo Sapiens
VTALLGNSL

SEQ ID NO: 2195 - protein, 9 aa, Homo Sapiens
ITSTSIIFL

SEQ ID NO: 2196 - protein, 9 aa, Homo Sapiens
ISIPFCFLS

SEQ ID NO: 2197 - protein, 9 aa, Homo Sapiens
TSTLQNITS

SEQ ID NO: 2198 - protein, 9 aa, Homo Sapiens
LSVTALLGN

SEQ ID NO: 2199 - protein, 9 aa, Homo Sapiens
QNITSTSII

SEQ ID NO: 2200 - protein, 9 aa, Homo Sapiens
LQNITSTSI

SEQ ID NO: 2201 - protein, 9 aa, Homo Sapiens
FITSTLQNI

SEQ ID NO: 2202 - protein, 9 aa, Homo Sapiens
SIPFCFLSV

SEQ ID NO: 2203 - protein, 9 aa, Homo Sapiens
SIIFLLTGV

SEQ ID NO: 2204 - protein, 9 aa, Homo Sapiens
GLEAFHTWI

SEQ ID NO: 2205 - protein, 9 aa, Homo Sapiens
LGNSLILFA

SEQ ID NO: 2206 - protein, 9 aa, Homo Sapiens
SLILFATIT

SEQ ID NO: 2207 - protein, 9 aa, Homo Sapiens
TLQNITSTS

SEQ ID NO: 2208 - protein, 9 aa, Homo Sapiens
STLQNITST

SEQ ID NO: 2209 - protein, 9 aa, Homo Sapiens
PGLEAFHTW

SEQ ID NO: 2210 - protein, 9 aa, Homo Sapiens
STSIIFLLT

SEQ ID NO: 2211 - protein, 9 aa, Homo Sapiens
FHTWISIPF

SEQ ID NO: 2212 - protein, 9 aa, Homo Sapiens
SVTALLGNS

SEQ ID NO: 2213 - protein, 9 aa, Homo Sapiens
GNSLILFAT

SEQ ID NO: 2214 - protein, 9 aa, Homo Sapiens
LTGVPGLEA

SEQ ID NO: 2215 - protein, 9 aa, Homo Sapiens
HTWISIPFC

SEQ ID NO: 2216 - protein, 9 aa, Homo Sapiens
PMYYFLSML

SEQ ID NO: 2217 - protein, 9 aa, Homo Sapiens
TWISIPFCF

SEQ ID NO: 2218 - protein, 9 aa, Homo Sapiens
ITSTLQNIT

SEQ ID NO: 2219 - protein, 9 aa, Homo Sapiens
CFLSVTALL

SEQ ID NO: 2220 - protein, 9 aa, Homo Sapiens
TSIIFLLTG

SEQ ID NO: 2221 - protein, 9 aa, Homo Sapiens
LHEPMYYFL

SEQ ID NO: 2222 - protein, 9 aa, Homo Sapiens
ITQPSLHEP

SEQ ID NO: 2223 - protein, 9 aa, Homo Sapiens
ATITQPSLH

SEQ ID NO: 2224 - protein, 9 aa, Homo Sapiens
FLSVTALLG

SEQ ID NO: 2225 - protein, 9 aa, Homo Sapiens
LILFATITQ

SEQ ID NO: 2226 - protein, 9 aa, Homo Sapiens
IIFLLTGVP

SEQ ID NO: 2227 - protein, 9 aa, Homo Sapiens
GVPGLEAFH

SEQ ID NO: 2228 - protein, 9 aa, Homo Sapiens
ILFATITQP

SEQ ID NO: 2229 - protein, 9 aa, Homo Sapiens
LFATITQPS

SEQ ID NO: 2230 - protein, 9 aa, Homo Sapiens
TITQPSLHE

SEQ ID NO: 2231 - protein, 9 aa, Homo Sapiens
LLTGVPGLE

SEQ ID NO: 2232 - protein, 9 aa, Homo Sapiens
LEAFHTWIS

SEQ ID NO: 2233 - protein, 9 aa, Homo Sapiens
HEPMYYFLS

SEQ ID NO: 2234 - protein, 9 aa, Homo Sapiens
PFCFLSVTA

SEQ ID NO: 2235 - protein, 9 aa, Homo Sapiens
IFLLTGVPG

SEQ ID NO: 2236 - protein, 9 aa, Homo Sapiens
AFHTWISIP

SEQ ID NO: 2237 - protein, 9 aa, Homo Sapiens
TSPLMNPVI

SEQ ID NO: 2238 - protein, 9 aa, Homo Sapiens
NTYLLTSPL

SEQ ID NO: 2239 - protein, 9 aa, Homo Sapiens
IANTYLLTS

SEQ ID NO: 2240 - protein, 9 aa, Homo Sapiens
LTSPLMNPV

SEQ ID NO: 2241 - protein, 9 aa, Homo Sapiens
TYLLTSPLM

SEQ ID NO: 2242 - protein, 9 aa, Homo Sapiens
YLLTSPLMN

SEQ ID NO: 2243 - protein, 9 aa, Homo Sapiens
MIANTYLLT

SEQ ID NO: 2244 - protein, 9 aa, Homo Sapiens
LLTSPLMNP

SEQ ID NO: 2245 - protein, 9 aa, Homo Sapiens
ANTYLLTSP

SEQ ID NO: 2246 - protein, 10 aa, Homo Sapiens
TPMVALLIRL

SEQ ID NO: 2247 - protein, 10 aa, Homo Sapiens
ISPLMNPVIY

SEQ ID NO: 2248 - protein, 10 aa, Homo Sapiens
HSYCYHPDVM

SEQ ID NO: 2249 - protein, 10 aa, Homo Sapiens
VSHIVAFAIY

SEQ ID NO: 2250 - protein, 10 aa, Homo Sapiens
ISFNACLSHM

SEQ ID NO: 2251 - protein, 10 aa, Homo Sapiens
ASPEERKETF

SEQ ID NO: 2252 - protein, 10 aa, Homo Sapiens
VASVIRGLLM

SEQ ID NO: 2253 - protein, 10 aa, Homo Sapiens
FSTVGVDLLL

SEQ ID NO: 2254 - protein, 10 aa, Homo Sapiens
ASVIRGLLML

SEQ ID NO: 2255 - protein, 10 aa, Homo Sapiens
ESSVLLAMAF

SEQ ID NO: 2256 - protein, 10 aa, Homo Sapiens
NSAVGLTAMF

SEQ ID NO: 2257 - protein, 10 aa, Homo Sapiens
LSHMFFIKFF

SEQ ID NO: 2258 - protein, 10 aa, Homo Sapiens
LSISTLVTML

SEQ ID NO: 2259 - protein, 10 aa, Homo Sapiens
KQAPAYVHTM

SEQ ID NO: 2260 - protein, 10 aa, Homo Sapiens
VAFAIYYIPL

SEQ ID NO: 2261 - protein, 10 aa, Homo Sapiens
QIRRAVIKIL

SEQ ID NO: 2262 - protein, 10 aa, Homo Sapiens
DTRINSAVGL

SEQ ID NO: 2263 - protein, 10 aa, Homo Sapiens
KTKQIRRAVI

SEQ ID NO: 2264 - protein, 10 aa, Homo Sapiens
GLSISTLVTM

SEQ ID NO: 2265 - protein, 10 aa, Homo Sapiens
AVSNPLRYAM

SEQ ID NO: 2266 - protein, 10 aa, Homo Sapiens
APAYVHTMIA

SEQ ID NO: 2267 - protein, 10 aa, Homo Sapiens
RLSYCHSQVL

SEQ ID NO: 2268 - protein, 10 aa, Homo Sapiens
YVHTMIANTY

SEQ ID NO: 2269 - protein, 10 aa, Homo Sapiens
ISTLVTMLSI

SEQ ID NO: 2270 - protein, 10 aa, Homo Sapiens
SPLMNPVIYS

SEQ ID NO: 2271 - protein, 10 aa, Homo Sapiens
SQVLHHSYCY

SEQ ID NO: 2272 - protein, 10 aa, Homo Sapiens
VGVDLLLILL

SEQ ID NO: 2273 - protein, 10 aa, Homo Sapiens
NPLRYAMILT

SEQ ID NO: 2274 - protein, 10 aa, Homo Sapiens
NTYLLISPLM

SEQ ID NO: 2275 - protein, 10 aa, Homo Sapiens
LSATDLGLSI

SEQ ID NO: 2276 - protein, 10 aa, Homo Sapiens
FVAVSNPLRY

SEQ ID NO: 2277 - protein, 10 aa, Homo Sapiens
INSAVGLTAM

SEQ ID NO: 2278 - protein, 10 aa, Homo Sapiens
VSNPLRYAMI

SEQ ID NO: 2279 - protein, 10 aa, Homo Sapiens
MVALLIRLSY

SEQ ID NO: 2280 - protein, 10 aa, Homo Sapiens
YCYHPDVMKL

SEQ ID NO: 2281 - protein, 10 aa, Homo Sapiens
DSRIAQIGVA

SEQ ID NO: 2282 - protein, 10 aa, Homo Sapiens
YAMILTDSRI

SEQ ID NO: 2283 - protein, 10 aa, Homo Sapiens
SPEERKETFS

SEQ ID NO: 2284 - protein, 10 aa, Homo Sapiens
QAPAYVHTMI

SEQ ID NO: 2285 - protein, 10 aa, Homo Sapiens
NACLSHMFFI

SEQ ID NO: 2286 - protein, 10 aa, Homo Sapiens
IAQIGVASVI

SEQ ID NO: 2287 - protein, 10 aa, Homo Sapiens
LLMLTPMVAL

SEQ ID NO: 2288 - protein, 10 aa, Homo Sapiens
LVTMLSIFWF

SEQ ID NO: 2289 - protein, 10 aa, Homo Sapiens
LLLILLSYVL

SEQ ID NO: 2290 - protein, 10 aa, Homo Sapiens
AIYYIPLISL

SEQ ID NO: 2291 - protein, 10 aa, Homo Sapiens
AMFSTVGVDL

SEQ ID NO: 2292 - protein, 10 aa, Homo Sapiens
HTMIANTYLL

SEQ ID NO: 2293 - protein, 10 aa, Homo Sapiens
VLLAMAFDRF

SEQ ID NO: 2294 - protein, 10 aa, Homo Sapiens
FTVMESSVLL

SEQ ID NO: 2295 - protein, 10 aa, Homo Sapiens
FLSMLSATDL

SEQ ID NO: 2296 - protein, 10 aa, Homo Sapiens
STLVTMLSIF

SEQ ID NO: 2297 - protein, 10 aa, Homo Sapiens
ANTYLLISPL

SEQ ID NO: 2298 - protein, 10 aa, Homo Sapiens
GVASVIRGLL

SEQ ID NO: 2299 - protein, 10 aa, Homo Sapiens
TVGVDLLLIL

SEQ ID NO: 2300 - protein, 10 aa, Homo Sapiens
FNACLSHMFF

SEQ ID NO: 2301 - protein, 10 aa, Homo Sapiens
LMLTPMVALL

SEQ ID NO: 2302 - protein, 10 aa, Homo Sapiens
LSYVLIIRTV

SEQ ID NO: 2303 - protein, 10 aa, Homo Sapiens
SMLSATDLGL

SEQ ID NO: 2304 - protein, 10 aa, Homo Sapiens
SNPLRYAMIL

SEQ ID NO: 2305 - protein, 10 aa, Homo Sapiens
IGVASVIRGL

SEQ ID NO: 2306 - protein, 10 aa, Homo Sapiens
CLSHMFFIKF

SEQ ID NO: 2307 - protein, 10 aa, Homo Sapiens
LISLSIVHRF

SEQ ID NO: 2308 - protein, 10 aa, Homo Sapiens
STCVSHIVAF

SEQ ID NO: 2309 - protein, 10 aa, Homo Sapiens
ILTDSRIAQI

SEQ ID NO: 2310 - protein, 10 aa, Homo Sapiens
KQIRRAVIKI

SEQ ID NO: 2311 - protein, 10 aa, Homo Sapiens
HPDVMKLSCT

SEQ ID NO: 2312 - protein, 10 aa, Homo Sapiens
SATDLGLSIS

SEQ ID NO: 2313 - protein, 10 aa, Homo Sapiens
MAFDRFVAVS

SEQ ID NO: 2314 - protein, 10 aa, Homo Sapiens
VMESSVLLAM

SEQ ID NO: 2315 - protein, 10 aa, Homo Sapiens
STVGVDLLLI

SEQ ID NO: 2316 - protein, 10 aa, Homo Sapiens
NVREISFNAC

SEQ ID NO: 2317 - protein, 10 aa, Homo Sapiens
LSCTDTRINS

SEQ ID NO: 2318 - protein, 10 aa, Homo Sapiens
FSTCVSHIVA

SEQ ID NO: 2319 - protein, 10 aa, Homo Sapiens
HSQVLHHSYC

SEQ ID NO: 2320 - protein, 10 aa, Homo Sapiens
TLVTMLSIFW

SEQ ID NO: 2321 - protein, 10 aa, Homo Sapiens
LAMAFDRFVA

SEQ ID NO: 2322 - protein, 10 aa, Homo Sapiens
VASPEERKET

SEQ ID NO: 2323 - protein, 10 aa, Homo Sapiens
HIVAFAIYYI

SEQ ID NO: 2324 - protein, 10 aa, Homo Sapiens
ETFSTCVSHI

SEQ ID NO: 2325 - protein, 10 aa, Homo Sapiens
TMIANTYLLI

SEQ ID NO: 2326 - protein, 10 aa, Homo Sapiens
RGLLMLTPMV

SEQ ID NO: 2327 - protein, 10 aa, Homo Sapiens
SIFWFNVREI

SEQ ID NO: 2328 - protein, 10 aa, Homo Sapiens
LLILLSYVLI

SEQ ID NO: 2329 - protein, 10 aa, Homo Sapiens
MLTPMVALLI

SEQ ID NO: 2330 - protein, 10 aa, Homo Sapiens
LILLSYVLII

SEQ ID NO: 2331 - protein, 10 aa, Homo Sapiens
RIAQIGVASV

SEQ ID NO: 2332 - protein, 10 aa, Homo Sapiens
VIYSVKTKQI

SEQ ID NO: 2333 - protein, 10 aa, Homo Sapiens
CVSHIVAFAI

SEQ ID NO: 2334 - protein, 10 aa, Homo Sapiens
LISPLMNPVI

SEQ ID NO: 2335 - protein, 10 aa, Homo Sapiens
FAIYYIPLIS

SEQ ID NO: 2336 - protein, 10 aa, Homo Sapiens
SVKTKQIRRA

SEQ ID NO: 2337 - protein, 10 aa, Homo Sapiens
KLSCTDTRIN

SEQ ID NO: 2338 - protein, 10 aa, Homo Sapiens
VAVSNPLRYA

SEQ ID NO: 2339 - protein, 10 aa, Homo Sapiens
FIKFFTVMES

SEQ ID NO: 2340 - protein, 10 aa, Homo Sapiens
VALLIRLSYC

SEQ ID NO: 2341 - protein, 10 aa, Homo Sapiens
IIRTVLSVAS

SEQ ID NO: 2342 - protein, 10 aa, Homo Sapiens
VIKILHSKET

SEQ ID NO: 2343 - protein, 10 aa, Homo Sapiens
SAVGLTAMFS

SEQ ID NO: 2344 - protein, 10 aa, Homo Sapiens
LTAMFSTVGV

SEQ ID NO: 2345 - protein, 10 aa, Homo Sapiens
NPVIYSVKTK

SEQ ID NO: 2346 - protein, 10 aa, Homo Sapiens
QPSLHEPMYY

SEQ ID NO: 2347 - protein, 10 aa, Homo Sapiens
EPMYYFLSML

SEQ ID NO: 2348 - protein, 10 aa, Homo Sapiens
VPGLEAFHTW

SEQ ID NO: 2349 - protein, 10 aa, Homo Sapiens
TALLGNSLIL

SEQ ID NO: 2350 - protein, 10 aa, Homo Sapiens
SLHEPMYYFL

SEQ ID NO: 2351 - protein, 10 aa, Homo Sapiens
IPFCFLSVTA

SEQ ID NO: 2352 - protein, 10 aa, Homo Sapiens
ITQPSLHEPM

SEQ ID NO: 2353 - protein, 10 aa, Homo Sapiens
TQPSLHEPMY

SEQ ID NO: 2354 - protein, 10 aa, Homo Sapiens
SVTALLGNSL

SEQ ID NO: 2355 - protein, 10 aa, Homo Sapiens
NITSTSIIFL

SEQ ID NO: 2356 - protein, 10 aa, Homo Sapiens
HTWISIPFCF

SEQ ID NO: 2357 - protein, 10 aa, Homo Sapiens
ISIPFCFLSV

SEQ ID NO: 2358 - protein, 10 aa, Homo Sapiens
FCFLSVTALL

SEQ ID NO: 2359 - protein, 10 aa, Homo Sapiens
QNITSTSIIF

SEQ ID NO: 2360 - protein, 10 aa, Homo Sapiens
TSIIFLLTGV

SEQ ID NO: 2361 - protein, 10 aa, Homo Sapiens
ALLGNSLILF

SEQ ID NO: 2362 - protein, 10 aa, Homo Sapiens
ITSTSIIFLL

SEQ ID NO: 2363 - protein, 10 aa, Homo Sapiens
LTGVPGLEAF

SEQ ID NO: 2364 - protein, 10 aa, Homo Sapiens
PSLHEPMYYF

SEQ ID NO: 2365 - protein, 10 aa, Homo Sapiens
TSTLQNITST

SEQ ID NO: 2366 - protein, 10 aa, Homo Sapiens
TSTSIIFLLT

SEQ ID NO: 2367 - protein, 10 aa, Homo Sapiens
LSVTALLGNS

SEQ ID NO: 2368 - protein, 10 aa, Homo Sapiens
NSLILFATIT

SEQ ID NO: 2369 - protein, 10 aa, Homo Sapiens
LQNITSTSII

SEQ ID NO: 2370 - protein, 10 aa, Homo Sapiens
VTALLGNSLI

SEQ ID NO: 2371 - protein, 10 aa, Homo Sapiens
GNSLILFATI

SEQ ID NO: 2372 - protein, 10 aa, Homo Sapiens
TLQNITSTSI

SEQ ID NO: 2373 - protein, 10 aa, Homo Sapiens
HEPMYYFLSM

SEQ ID NO: 2374 - protein, 10 aa, Homo Sapiens
GVPGLEAFHT

SEQ ID NO: 2375 - protein, 10 aa, Homo Sapiens
IFLLTGVPGL

SEQ ID NO: 2376 - protein, 10 aa, Homo Sapiens
LGNSLILFAT

SEQ ID NO: 2377 - protein, 10 aa, Homo Sapiens
FITSTLQNIT

SEQ ID NO: 2378 - protein, 10 aa, Homo Sapiens
SIPFCFLSVT

SEQ ID NO: 2379 - protein, 10 aa, Homo Sapiens
FLSVTALLGN

SEQ ID NO: 2380 - protein, 10 aa, Homo Sapiens
WISIPFCFLS

SEQ ID NO: 2381 - protein, 10 aa, Homo Sapiens
ILFATITQPS

SEQ ID NO: 2382 - protein, 10 aa, Homo Sapiens
STLQNITSTS

SEQ ID NO: 2383 - protein, 10 aa, Homo Sapiens
LLTGVPGLEA

SEQ ID NO: 2384 - protein, 10 aa, Homo Sapiens
LFATITQPSL

SEQ ID NO: 2385 - protein, 10 aa, Homo Sapiens
LLGNSLILFA

SEQ ID NO: 2386 - protein, 10 aa, Homo Sapiens
TWISIPFCFL

SEQ ID NO: 2387 - protein, 10 aa, Homo Sapiens
AFHTWISIPF

SEQ ID NO: 2388 - protein, 10 aa, Homo Sapiens
ITSTLQNITS

SEQ ID NO: 2389 - protein, 10 aa, Homo Sapiens
PGLEAFHTWI

SEQ ID NO: 2390 - protein, 10 aa, Homo Sapiens
LEAFHTWISI

SEQ ID NO: 2391 - protein, 10 aa, Homo Sapiens
FATITQPSLH

SEQ ID NO: 2392 - protein, 10 aa, Homo Sapiens
EAFHTWISIP

SEQ ID NO: 2393 - protein, 10 aa, Homo Sapiens
GLEAFHTWIS

SEQ ID NO: 2394 - protein, 10 aa, Homo Sapiens
PFCFLSVTAL

SEQ ID NO: 2395 - protein, 10 aa, Homo Sapiens
FHTWISIPFC

SEQ ID NO: 2396 - protein, 10 aa, Homo Sapiens
TGVPGLEAFH

SEQ ID NO: 2397 - protein, 10 aa, Homo Sapiens
FLLTGVPGLE

SEQ ID NO: 2398 - protein, 10 aa, Homo Sapiens
LILFATITQP

SEQ ID NO: 2399 - protein, 10 aa, Homo Sapiens
ATITQPSLHE

SEQ ID NO: 2400 - protein, 10 aa, Homo Sapiens
PMYYFLSMLS

SEQ ID NO: 2401 - protein, 10 aa, Homo Sapiens
STSIIFLLTG

SEQ ID NO: 2402 - protein, 10 aa, Homo Sapiens
IIFLLTGVPG

SEQ ID NO: 2403 - protein, 10 aa, Homo Sapiens
SLILFATITQ

SEQ ID NO: 2404 - protein, 10 aa, Homo Sapiens
SIIFLLTGVP

SEQ ID NO: 2405 - protein, 10 aa, Homo Sapiens
TITQPSLHEP

SEQ ID NO: 2406 - protein, 10 aa, Homo Sapiens
LHEPMYYFLS

SEQ ID NO: 2407 - protein, 10 aa, Homo Sapiens
CFLSVTALLG

SEQ ID NO: 2408 - protein, 10 aa, Homo Sapiens
TSPLMNPVIY

SEQ ID NO: 2409 - protein, 10 aa, Homo Sapiens
NTYLLTSPLM

SEQ ID NO: 2410 - protein, 10 aa, Homo Sapiens
ANTYLLTSPL

SEQ ID NO: 2411 - protein, 10 aa, Homo Sapiens
LTSPLMNPVI

SEQ ID NO: 2412 - protein, 10 aa, Homo Sapiens
LLTSPLMNPV

SEQ ID NO: 2413 - protein, 10 aa, Homo Sapiens
TMIANTYLLT

SEQ ID NO: 2414 - protein, 10 aa, Homo Sapiens
MIANTYLLTS

SEQ ID NO: 2415 - protein, 10 aa, Homo Sapiens
IANTYLLTSP

SEQ ID NO: 2416 - protein, 10 aa, Homo Sapiens
YLLTSPLMNP

SEQ ID NO: 2417 - protein, 10 aa, Homo Sapiens
TYLLTSPLMN

SEQ ID NO: 2418 - protein, 254 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLISPLMNPVIYSVKTKQIRRAVIKILHSKET

SEQ ID NO: 2419 - protein, 70 aa, Homo Sapiens
FITSTLQNITSTSIIFLLTGVPGLEAFHTWISIPFCFLSVTALLGNSLILFATITQPSLHEPMYYFLSML

SEQ ID NO: 2420 - protein, 71 aa, Homo Sapiens
FITSTLQNITSTSIIFLLTGVPGLEAFHTWISIPFCFLSVTALLGNSLILFATITQPSLHEPMYYFLSMLS

SEQ ID NO: 2421 - protein, 76 aa, Homo Sapiens
FITSTLQNITSTSIIFLLTGVPGLEAFHTWISIPFCFLSVTALLGNSLILFATITQPSLHEPMYYFLSMLSATDLG

SEQ ID NO: 2422 - protein, 17 aa, Homo Sapiens
MIANTYLLTSPLMNPVI

SEQ ID NO: 2423 - protein, 19 aa, Homo Sapiens
TMIANTYLLTSPLMNPVIY

SEQ ID NO: 2424 - protein, 29 aa, Homo Sapiens
PAYVHTMIANTYLLTSPLMNPVIYSVKTK

SEQ ID NO: 2425 - protein, 9 aa, Homo Sapiens
LMNPVIYSV

SEQ ID NO: 2426 - protein, 9 aa, Homo Sapiens
LLLILLSYV

SEQ ID NO: 2427 - protein, 9 aa, Homo Sapiens
LIIRTVLSV

SEQ ID NO: 2428 - protein, 9 aa, Homo Sapiens
ILLSYVLII

SEQ ID NO: 2429 - protein, 9 aa, Homo Sapiens
GLLMLTPMV

SEQ ID NO: 2430 - protein, 9 aa, Homo Sapiens
MLTPMVALL

SEQ ID NO: 2431 - protein, 9 aa, Homo Sapiens
IAQIGVASV

SEQ ID NO: 2432 - protein, 9 aa, Homo Sapiens
LMLTPMVAL

SEQ ID NO: 2433 - protein, 9 aa, Homo Sapiens
LLILLSYVL

SEQ ID NO: 2434 - protein, 9 aa, Homo Sapiens
DLGLSISTL

SEQ ID NO: 2435 - protein, 9 aa, Homo Sapiens
SISTLVTML

SEQ ID NO: 2436 - protein, 9 aa, Homo Sapiens
SVIRGLLML

SEQ ID NO: 2437 - protein, 9 aa, Homo Sapiens
LISPLMNPV

SEQ ID NO: 2438 - protein, 9 aa, Homo Sapiens
TMIANTYLL

SEQ ID NO: 2439 - protein, 9 aa, Homo Sapiens
MLSATDLGL

SEQ ID NO: 2440 - protein, 9 aa, Homo Sapiens
GVASVIRGL

SEQ ID NO: 2441 - protein, 9 aa, Homo Sapiens
GLTAMFSTV

SEQ ID NO: 2442 - protein, 9 aa, Homo Sapiens
LILLSYVLI

SEQ ID NO: 2443 - protein, 9 aa, Homo Sapiens
QIRRAVIKI

SEQ ID NO: 2444 - protein, 9 aa, Homo Sapiens
MLSIFWFNV

SEQ ID NO: 2445 - protein, 9 aa, Homo Sapiens
YIPLISLSI

SEQ ID NO: 2446 - protein, 9 aa, Homo Sapiens
AMILTDSRI

SEQ ID NO: 2447 - protein, 9 aa, Homo Sapiens
LTDSRIAQI

SEQ ID NO: 2448 - protein, 9 aa, Homo Sapiens
VIRGLLMLT

SEQ ID NO: 2449 - protein, 9 aa, Homo Sapiens
PMVALLIRL

SEQ ID NO: 2450 - protein, 9 aa, Homo Sapiens
GVDLLLILL

SEQ ID NO: 2451 - protein, 9 aa, Homo Sapiens
IVAFAIYYI

SEQ ID NO: 2452 - protein, 9 aa, Homo Sapiens
FAIYYIPLI

SEQ ID NO: 2453 - protein, 9 aa, Homo Sapiens
IYYIPLISL

SEQ ID NO: 2454 - protein, 9 aa, Homo Sapiens
NTYLLISPL

SEQ ID NO: 2455 - protein, 9 aa, Homo Sapiens
STLVTMLSI

SEQ ID NO: 2456 - protein, 9 aa, Homo Sapiens
TVMESSVLL

SEQ ID NO: 2457 - protein, 9 aa, Homo Sapiens
MAFDRFVAV

SEQ ID NO: 2458 - protein, 9 aa, Homo Sapiens
RLSYCHSQV

SEQ ID NO: 2459 - protein, 9 aa, Homo Sapiens
KLSCTDTRI

SEQ ID NO: 2460 - protein, 9 aa, Homo Sapiens
TAMFSTVGV

SEQ ID NO: 2461 - protein, 9 aa, Homo Sapiens
STVGVDLLL

SEQ ID NO: 2462 - protein, 9 aa, Homo Sapiens
MIANTYLLI

SEQ ID NO: 2463 - protein, 9 aa, Homo Sapiens
LLISPLMNP

SEQ ID NO: 2464 - protein, 9 aa, Homo Sapiens
SATDLGLSI

SEQ ID NO: 2465 - protein, 9 aa, Homo Sapiens
GLSISTLVT

SEQ ID NO: 2466 - protein, 9 aa, Homo Sapiens
LAMAFDRFV

SEQ ID NO: 2467 - protein, 9 aa, Homo Sapiens
ALLIRLSYC

SEQ ID NO: 2468 - protein, 9 aa, Homo Sapiens
CYHPDVMKL

SEQ ID NO: 2469 - protein, 9 aa, Homo Sapiens
VGVDLLLIL

SEQ ID NO: 2470 - protein, 9 aa, Homo Sapiens
DLLLILLSY

SEQ ID NO: 2471 - protein, 9 aa, Homo Sapiens
SYVLIIRTV

SEQ ID NO: 2472 - protein, 9 aa, Homo Sapiens
YVLIIRTVL

SEQ ID NO: 2473 - protein, 9 aa, Homo Sapiens
IIRTVLSVA

SEQ ID NO: 2474 - protein, 9 aa, Homo Sapiens
IPLISLSIV

SEQ ID NO: 2475 - protein, 9 aa, Homo Sapiens
VMESSVLLA

SEQ ID NO: 2476 - protein, 9 aa, Homo Sapiens
LLMLTPMVA

SEQ ID NO: 2477 - protein, 9 aa, Homo Sapiens
RINSAVGLT

SEQ ID NO: 2478 - protein, 9 aa, Homo Sapiens
TVGVDLLLI

SEQ ID NO: 2479 - protein, 9 aa, Homo Sapiens
VLIIRTVLS

SEQ ID NO: 2480 - protein, 9 aa, Homo Sapiens
FLSMLSATD

SEQ ID NO: 2481 - protein, 9 aa, Homo Sapiens
LSISTLVTM

SEQ ID NO: 2482 - protein, 9 aa, Homo Sapiens
IFWFNVREI

SEQ ID NO: 2483 - protein, 9 aa, Homo Sapiens
LLIRLSYCH

SEQ ID NO: 2484 - protein, 9 aa, Homo Sapiens
FSTVGVDLL

SEQ ID NO: 2485 - protein, 9 aa, Homo Sapiens
LISLSIVHR

SEQ ID NO: 2486 - protein, 9 aa, Homo Sapiens
QAPAYVHTM

SEQ ID NO: 2487 - protein, 9 aa, Homo Sapiens
YVHTMIANT

SEQ ID NO: 2488 - protein, 9 aa, Homo Sapiens
REISFNACL

SEQ ID NO: 2489 - protein, 9 aa, Homo Sapiens
FTVMESSVL

SEQ ID NO: 2490 - protein, 9 aa, Homo Sapiens
AMAFDRFVA

SEQ ID NO: 2491 - protein, 9 aa, Homo Sapiens
AVSNPLRYA

SEQ ID NO: 2492 - protein, 9 aa, Homo Sapiens
VASVIRGLL

SEQ ID NO: 2493 - protein, 9 aa, Homo Sapiens
LTPMVALLI

SEQ ID NO: 2494 - protein, 9 aa, Homo Sapiens
CTDTRINSA

SEQ ID NO: 2495 - protein, 9 aa, Homo Sapiens
TRINSAVGL

SEQ ID NO: 2496 - protein, 9 aa, Homo Sapiens
AMFSTVGVD

SEQ ID NO: 2497 - protein, 9 aa, Homo Sapiens
LLSYVLIIR

SEQ ID NO: 2498 - protein, 9 aa, Homo Sapiens
AFAIYYIPL

SEQ ID NO: 2499 - protein, 9 aa, Homo Sapiens
HTMIANTYL

SEQ ID NO: 2500 - protein, 9 aa, Homo Sapiens
YLLISPLMN

SEQ ID NO: 2501 - protein, 9 aa, Homo Sapiens
KTKQIRRAV

SEQ ID NO: 2502 - protein, 9 aa, Homo Sapiens
IRRAVIKIL

SEQ ID NO: 2503 - protein, 9 aa, Homo Sapiens
AVIKILHSK

SEQ ID NO: 2504 - protein, 9 aa, Homo Sapiens
SMLSATDLG

SEQ ID NO: 2505 - protein, 9 aa, Homo Sapiens
LGLSISTLV

SEQ ID NO: 2506 - protein, 9 aa, Homo Sapiens
TLVTMLSIF

SEQ ID NO: 2507 - protein, 9 aa, Homo Sapiens
SIFWFNVRE

SEQ ID NO: 2508 - protein, 9 aa, Homo Sapiens
MFFIKFFTV

SEQ ID NO: 2509 - protein, 9 aa, Homo Sapiens
LLAMAFDRF

SEQ ID NO: 2510 - protein, 9 aa, Homo Sapiens
MILTDSRIA

SEQ ID NO: 2511 - protein, 9 aa, Homo Sapiens
AQIGVASVI

SEQ ID NO: 2512 - protein, 9 aa, Homo Sapiens
VLSVASPEE

SEQ ID NO: 2513 - protein, 9 aa, Homo Sapiens
CVSHIVAFA

SEQ ID NO: 2514 - protein, 9 aa, Homo Sapiens
YFLSMLSAT

SEQ ID NO: 2515 - protein, 9 aa, Homo Sapiens
LSMLSATDL

SEQ ID NO: 2516 - protein, 9 aa, Homo Sapiens
VLLAMAFDR

SEQ ID NO: 2517 - protein, 9 aa, Homo Sapiens
NPLRYAMIL

SEQ ID NO: 2518 - protein, 9 aa, Homo Sapiens
ILTDSRIAQ

SEQ ID NO: 2519 - protein, 9 aa, Homo Sapiens
RIAQIGVAS

SEQ ID NO: 2520 - protein, 9 aa, Homo Sapiens
LSYCHSQVL

SEQ ID NO: 2521 - protein, 9 aa, Homo Sapiens
HSYCYHPDV

SEQ ID NO: 2522 - protein, 9 aa, Homo Sapiens
NSAVGLTAM

SEQ ID NO: 2523 - protein, 9 aa, Homo Sapiens
SAVGLTAMF

SEQ ID NO: 2524 - protein, 9 aa, Homo Sapiens
IANTYLLIS

SEQ ID NO: 2525 - protein, 9 aa, Homo Sapiens
PLMNPVIYS

SEQ ID NO: 2526 - protein, 9 aa, Homo Sapiens
ATDLGLSIS

SEQ ID NO: 2527 - protein, 9 aa, Homo Sapiens
ACLSHMFFI

SEQ ID NO: 2528 - protein, 9 aa, Homo Sapiens
HMFFIKFFT

SEQ ID NO: 2529 - protein, 9 aa, Homo Sapiens
FIKFFTVME

SEQ ID NO: 2530 - protein, 9 aa, Homo Sapiens
FFTVMESSV

SEQ ID NO: 2531 - protein, 9 aa, Homo Sapiens
SNPLRYAMI

SEQ ID NO: 2532 - protein, 9 aa, Homo Sapiens
YAMILTDSR

SEQ ID NO: 2533 - protein, 9 aa, Homo Sapiens
SRIAQIGVA

SEQ ID NO: 2534 - protein, 9 aa, Homo Sapiens
VMKLSCTDT

SEQ ID NO: 2535 - protein, 9 aa, Homo Sapiens
MFSTVGVDL

SEQ ID NO: 2536 - protein, 9 aa, Homo Sapiens
LSYVLIIRT

SEQ ID NO: 2537 - protein, 9 aa, Homo Sapiens
RTVLSVASP

SEQ ID NO: 2538 - protein, 9 aa, Homo Sapiens
TFSTCVSHI

SEQ ID NO: 2539 - protein, 9 aa, Homo Sapiens
SLSIVHRFG

SEQ ID NO: 2540 - protein, 9 aa, Homo Sapiens
SIVHRFGKQ

SEQ ID NO: 2541 - protein, 9 aa, Homo Sapiens
FGKQAPAYV

SEQ ID NO: 2542 - protein, 9 aa, Homo Sapiens
VIYSVKTKQ

SEQ ID NO: 2543 - protein, 9 aa, Homo Sapiens
IYSVKTKQI

SEQ ID NO: 2544 - protein, 9 aa, Homo Sapiens
TDLGLSIST

SEQ ID NO: 2545 - protein, 9 aa, Homo Sapiens
SFNACLSHM

SEQ ID NO: 2546 - protein, 9 aa, Homo Sapiens
RFVAVSNPL

SEQ ID NO: 2547 - protein, 9 aa, Homo Sapiens
VSNPLRYAM

SEQ ID NO: 2548 - protein, 9 aa, Homo Sapiens
MVALLIRLS

SEQ ID NO: 2549 - protein, 9 aa, Homo Sapiens
VLHHSYCYH

SEQ ID NO: 2550 - protein, 9 aa, Homo Sapiens
FSTCVSHIV

SEQ ID NO: 2551 - protein, 9 aa, Homo Sapiens
AIYYIPLIS

SEQ ID NO: 2552 - protein, 9 aa, Homo Sapiens
YYIPLISLS

SEQ ID NO: 2553 - protein, 9 aa, Homo Sapiens
KQAPAYVHT

SEQ ID NO: 2554 - protein, 9 aa, Homo Sapiens
APAYVHTMI

SEQ ID NO: 2555 - protein, 9 aa, Homo Sapiens
ISPLMNPVI

SEQ ID NO: 2556 - protein, 9 aa, Homo Sapiens
VIKILHSKE

SEQ ID NO: 2557 - protein, 9 aa, Homo Sapiens
YYFLSMLSA

SEQ ID NO: 2558 - protein, 9 aa, Homo Sapiens
VTMLSIFWF

SEQ ID NO: 2559 - protein, 9 aa, Homo Sapiens
TMLSIFWFN

SEQ ID NO: 2560 - protein, 9 aa, Homo Sapiens
NVREISFNA

SEQ ID NO: 2561 - protein, 9 aa, Homo Sapiens
CLSHMFFIK

SEQ ID NO: 2562 - protein, 9 aa, Homo Sapiens
MESSVLLAM

SEQ ID NO: 2563 - protein, 9 aa, Homo Sapiens
SVLLAMAFD

SEQ ID NO: 2564 - protein, 9 aa, Homo Sapiens
PLRYAMILT

SEQ ID NO: 2565 - protein, 9 aa, Homo Sapiens
LRYAMILTD

SEQ ID NO: 2566 - protein, 9 aa, Homo Sapiens
DSRIAQIGV

SEQ ID NO: 2567 - protein, 9 aa, Homo Sapiens
QIGVASVIR

SEQ ID NO: 2568 - protein, 9 aa, Homo Sapiens
RGLLMLTPM

SEQ ID NO: 2569 - protein, 9 aa, Homo Sapiens
VALLIRLSY

SEQ ID NO: 2570 - protein, 9 aa, Homo Sapiens
LIRLSYCHS

SEQ ID NO: 2571 - protein, 9 aa, Homo Sapiens
TDTRINSAV

SEQ ID NO: 2572 - protein, 9 aa, Homo Sapiens
RKETFSTCV

SEQ ID NO: 2573 - protein, 9 aa, Homo Sapiens
STCVSHIVA

SEQ ID NO: 2574 - protein, 9 aa, Homo Sapiens
VSHIVAFAI

SEQ ID NO: 2575 - protein, 9 aa, Homo Sapiens
PLISLSIVH

SEQ ID NO: 2576 - protein, 9 aa, Homo Sapiens
IVHRFGKQA

SEQ ID NO: 2577 - protein, 9 aa, Homo Sapiens
HRFGKQAPA

SEQ ID NO: 2578 - protein, 9 aa, Homo Sapiens
TKQIRRAVI

SEQ ID NO: 2579 - protein, 9 aa, Homo Sapiens
RAVIKILHS

SEQ ID NO: 2580 - protein, 9 aa, Homo Sapiens
AFDRFVAVS

SEQ ID NO: 2581 - protein, 9 aa, Homo Sapiens
INSAVGLTA

SEQ ID NO: 2582 - protein, 9 aa, Homo Sapiens
VGLTAMFST

SEQ ID NO: 2583 - protein, 9 aa, Homo Sapiens
LTAMFSTVG

SEQ ID NO: 2584 - protein, 9 aa, Homo Sapiens
VDLLLILLS

SEQ ID NO: 2585 - protein, 9 aa, Homo Sapiens
SVASPEERK

SEQ ID NO: 2586 - protein, 9 aa, Homo Sapiens
VASPEERKE

SEQ ID NO: 2587 - protein, 9 aa, Homo Sapiens
ASPEERKET

SEQ ID NO: 2588 - protein, 9 aa, Homo Sapiens
HIVAFAIYY

SEQ ID NO: 2589 - protein, 9 aa, Homo Sapiens
ISLSIVHRF

SEQ ID NO: 2590 - protein, 9 aa, Homo Sapiens
NPVIYSVKT

SEQ ID NO: 2591 - protein, 9 aa, Homo Sapiens
IKILHSKET

SEQ ID NO: 2592 - protein, 9 aa, Homo Sapiens
LSATDLGLS

SEQ ID NO: 2593 - protein, 9 aa, Homo Sapiens
FFIKFFTVM

SEQ ID NO: 2594 - protein, 9 aa, Homo Sapiens
IKFFTVMES

SEQ ID NO: 2595 - protein, 9 aa, Homo Sapiens
ESSVLLAMA

SEQ ID NO: 2596 - protein, 9 aa, Homo Sapiens
FVAVSNPLR

SEQ ID NO: 2597 - protein, 9 aa, Homo Sapiens
IRLSYCHSQ

SEQ ID NO: 2598 - protein, 9 aa, Homo Sapiens
PAYVHTMIA

SEQ ID NO: 2599 - protein, 9 aa, Homo Sapiens
VKTKQIRRA

SEQ ID NO: 2600 - protein, 9 aa, Homo Sapiens
ASVIRGLLM

SEQ ID NO: 2601 - protein, 9 aa, Homo Sapiens
YCHSQVLHH

SEQ ID NO: 2602 - protein, 9 aa, Homo Sapiens
QVLHHSYCY

SEQ ID NO: 2603 - protein, 9 aa, Homo Sapiens
DVMKLSCTD

SEQ ID NO: 2604 - protein, 9 aa, Homo Sapiens
TCVSHIVAF

SEQ ID NO: 2605 - protein, 9 aa, Homo Sapiens
VAFAIYYIP

SEQ ID NO: 2606 - protein, 9 aa, Homo Sapiens
ANTYLLISP

SEQ ID NO: 2607 - protein, 9 aa, Homo Sapiens
TYLLISPLM

SEQ ID NO: 2608 - protein, 9 aa, Homo Sapiens
PVIYSVKTK

SEQ ID NO: 2609 - protein, 9 aa, Homo Sapiens
LVTMLSIFW

SEQ ID NO: 2610 - protein, 9 aa, Homo Sapiens
ISFNACLSH

SEQ ID NO: 2611 - protein, 9 aa, Homo Sapiens
SHMFFIKFF

SEQ ID NO: 2612 - protein, 9 aa, Homo Sapiens
VAVSNPLRY

SEQ ID NO: 2613 - protein, 9 aa, Homo Sapiens
RYAMILTDS

SEQ ID NO: 2614 - protein, 9 aa, Homo Sapiens
IGVASVIRG

SEQ ID NO: 2615 - protein, 9 aa, Homo Sapiens
IRGLLMLTP

SEQ ID NO: 2616 - protein, 9 aa, Homo Sapiens
TPMVALLIR

SEQ ID NO: 2617 - protein, 9 aa, Homo Sapiens
YCYHPDVMK

SEQ ID NO: 2618 - protein, 9 aa, Homo Sapiens
PDVMKLSCT

SEQ ID NO: 2619 - protein, 9 aa, Homo Sapiens
MKLSCTDTR

SEQ ID NO: 2620 - protein, 9 aa, Homo Sapiens
AVGLTAMFS

SEQ ID NO: 2621 - protein, 9 aa, Homo Sapiens
TVLSVASPE

SEQ ID NO: 2622 - protein, 9 aa, Homo Sapiens
ETFSTCVSH

SEQ ID NO: 2623 - protein, 9 aa, Homo Sapiens
SHIVAFAIY

SEQ ID NO: 2624 - protein, 9 aa, Homo Sapiens
SPLMNPVIY

SEQ ID NO: 2625 - protein, 9 aa, Homo Sapiens
SVKTKQIRR

SEQ ID NO: 2626 - protein, 9 aa, Homo Sapiens
FNVREISFN

SEQ ID NO: 2627 - protein, 9 aa, Homo Sapiens
FNACLSHMF

SEQ ID NO: 2628 - protein, 9 aa, Homo Sapiens
LSHMFFIKF

SEQ ID NO: 2629 - protein, 9 aa, Homo Sapiens
CHSQVLHHS

SEQ ID NO: 2630 - protein, 9 aa, Homo Sapiens
SYCYHPDVM

SEQ ID NO: 2631 - protein, 9 aa, Homo Sapiens
DTRINSAVG

SEQ ID NO: 2632 - protein, 9 aa, Homo Sapiens
IRTVLSVAS

SEQ ID NO: 2633 - protein, 9 aa, Homo Sapiens
SPEERKETF

SEQ ID NO: 2634 - protein, 9 aa, Homo Sapiens
EERKETFST

SEQ ID NO: 2635 - protein, 9 aa, Homo Sapiens
LSIVHRFGK

SEQ ID NO: 2636 - protein, 9 aa, Homo Sapiens
KQIRRAVIK

SEQ ID NO: 2637 - protein, 9 aa, Homo Sapiens
LSIFWFNVR

SEQ ID NO: 2638 - protein, 9 aa, Homo Sapiens
EISFNACLS

SEQ ID NO: 2639 - protein, 9 aa, Homo Sapiens
NACLSHMFF

SEQ ID NO: 2640 - protein, 9 aa, Homo Sapiens
KFFTVMESS

SEQ ID NO: 2641 - protein, 9 aa, Homo Sapiens
SSVLLAMAF

SEQ ID NO: 2642 - protein, 9 aa, Homo Sapiens
FDRFVAVSN

SEQ ID NO: 2643 - protein, 9 aa, Homo Sapiens
DRFVAVSNP

SEQ ID NO: 2644 - protein, 9 aa, Homo Sapiens
SYCHSQVLH

SEQ ID NO: 2645 - protein, 9 aa, Homo Sapiens
HSQVLHHSY

SEQ ID NO: 2646 - protein, 9 aa, Homo Sapiens
LHHSYCYHP

SEQ ID NO: 2647 - protein, 9 aa, Homo Sapiens
LSCTDTRIN

SEQ ID NO: 2648 - protein, 9 aa, Homo Sapiens
LSVASPEER

SEQ ID NO: 2649 - protein, 9 aa, Homo Sapiens
ISTLVTMLS

SEQ ID NO: 2650 - protein, 9 aa, Homo Sapiens
WFNVREISF

SEQ ID NO: 2651 - protein, 9 aa, Homo Sapiens
HPDVMKLSC

SEQ ID NO: 2652 - protein, 9 aa, Homo Sapiens
VHRFGKQAP

SEQ ID NO: 2653 - protein, 9 aa, Homo Sapiens
GKQAPAYVH

SEQ ID NO: 2654 - protein, 9 aa, Homo Sapiens
AYVHTMIAN

SEQ ID NO: 2655 - protein, 9 aa, Homo Sapiens
VHTMIANTY

SEQ ID NO: 2656 - protein, 9 aa, Homo Sapiens
FWFNVREIS

SEQ ID NO: 2657 - protein, 9 aa, Homo Sapiens
VREISFNAC

SEQ ID NO: 2658 - protein, 9 aa, Homo Sapiens
SQVLHHSYC

SEQ ID NO: 2659 - protein, 9 aa, Homo Sapiens
YHPDVMKLS

SEQ ID NO: 2660 - protein, 9 aa, Homo Sapiens
SCTDTRINS

SEQ ID NO: 2661 - protein, 9 aa, Homo Sapiens
RFGKQAPAY

SEQ ID NO: 2662 - protein, 9 aa, Homo Sapiens
YSVKTKQIR

SEQ ID NO: 2663 - protein, 9 aa, Homo Sapiens
RRAVIKILH

SEQ ID NO: 2664 - protein, 9 aa, Homo Sapiens
MYYFLSMLS

SEQ ID NO: 2665 - protein, 9 aa, Homo Sapiens
KETFSTCVS

SEQ ID NO: 2666 - protein, 9 aa, Homo Sapiens
PEERKETFS

SEQ ID NO: 2667 - protein, 9 aa, Homo Sapiens
VALLIRLSY

SEQ ID NO: 2668 - protein, 9 aa, Homo Sapiens
VAVSNPLRY

SEQ ID NO: 2669 - protein, 9 aa, Homo Sapiens
DLLLILLSY

SEQ ID NO: 2670 - protein, 9 aa, Homo Sapiens
VMESSVLLA

SEQ ID NO: 2671 - protein, 9 aa, Homo Sapiens
SHIVAFAIY

SEQ ID NO: 2672 - protein, 9 aa, Homo Sapiens
ATDLGLSIS

SEQ ID NO: 2673 - protein, 9 aa, Homo Sapiens
HSQVLHHSY

SEQ ID NO: 2674 - protein, 9 aa, Homo Sapiens
STVGVDLLL

SEQ ID NO: 2675 - protein, 9 aa, Homo Sapiens
HIVAFAIYY

SEQ ID NO: 2676 - protein, 9 aa, Homo Sapiens
RFGKQAPAY

SEQ ID NO: 2677 - protein, 9 aa, Homo Sapiens
SPLMNPVIY

SEQ ID NO: 2678 - protein, 9 aa, Homo Sapiens
LTDSRIAQI

SEQ ID NO: 2679 - protein, 9 aa, Homo Sapiens
LTPMVALLI

SEQ ID NO: 2680 - protein, 9 aa, Homo Sapiens
HPDVMKLSC

SEQ ID NO: 2681 - protein, 9 aa, Homo Sapiens
CTDTRINSA

SEQ ID NO: 2682 - protein, 9 aa, Homo Sapiens
GVDLLLILL

SEQ ID NO: 2683 - protein, 9 aa, Homo Sapiens
VHTMIANTY

SEQ ID NO: 2684 - protein, 9 aa, Homo Sapiens
QVLHHSYCY

SEQ ID NO: 2685 - protein, 9 aa, Homo Sapiens
STLVTMLSI

SEQ ID NO: 2686 - protein, 9 aa, Homo Sapiens
VREISFNAC

SEQ ID NO: 2687 - protein, 9 aa, Homo Sapiens
ASVIRGLLM

SEQ ID NO: 2688 - protein, 9 aa, Homo Sapiens
LSHMFFIKF

SEQ ID NO: 2689 - protein, 9 aa, Homo Sapiens
AFDRFVAVS

SEQ ID NO: 2690 - protein, 9 aa, Homo Sapiens
STCVSHIVA

SEQ ID NO: 2691 - protein, 9 aa, Homo Sapiens
SPEERKETF

SEQ ID NO: 2692 - protein, 9 aa, Homo Sapiens
SVIRGLLML

SEQ ID NO: 2693 - protein, 9 aa, Homo Sapiens
YCHSQVLHH

SEQ ID NO: 2694 - protein, 9 aa, Homo Sapiens
ISFNACLSH

SEQ ID NO: 2695 - protein, 9 aa, Homo Sapiens
VSNPLRYAM

SEQ ID NO: 2696 - protein, 9 aa, Homo Sapiens
FSTVGVDLL

SEQ ID NO: 2697 - protein, 9 aa, Homo Sapiens
PEERKETFS

SEQ ID NO: 2698 - protein, 9 aa, Homo Sapiens
RKETFSTCV

SEQ ID NO: 2699 - protein, 9 aa, Homo Sapiens
YLLISPLMN

SEQ ID NO: 2700 - protein, 9 aa, Homo Sapiens
SATDLGLSI

SEQ ID NO: 2701 - protein, 9 aa, Homo Sapiens
INSAVGLTA

SEQ ID NO: 2702 - protein, 9 aa, Homo Sapiens
VDLLLILLS

SEQ ID NO: 2703 - protein, 9 aa, Homo Sapiens
ILLSYVLII

SEQ ID NO: 2704 - protein, 9 aa, Homo Sapiens
YYFLSMLSA

SEQ ID NO: 2705 - protein, 9 aa, Homo Sapiens
GLSISTLVT

SEQ ID NO: 2706 - protein, 9 aa, Homo Sapiens
ISTLVTMLS

SEQ ID NO: 2707 - protein, 9 aa, Homo Sapiens
LSIFWFNVR

SEQ ID NO: 2708 - protein, 9 aa, Homo Sapiens
FTVMESSVL

SEQ ID NO: 2709 - protein, 9 aa, Homo Sapiens
MESSVLLAM

SEQ ID NO: 2710 - protein, 9 aa, Homo Sapiens
DSRIAQIGV

SEQ ID NO: 2711 - protein, 9 aa, Homo Sapiens
MLTPMVALL

SEQ ID NO: 2712 - protein, 9 aa, Homo Sapiens
TVGVDLLLI

SEQ ID NO: 2713 - protein, 9 aa, Homo Sapiens
LSYVLIIRT

SEQ ID NO: 2714 - protein, 9 aa, Homo Sapiens
YYIPLISLS

SEQ ID NO: 2715 - protein, 9 aa, Homo Sapiens
YIPLISLSI

SEQ ID NO: 2716 - protein, 9 aa, Homo Sapiens
MIANTYLLI

SEQ ID NO: 2717 - protein, 9 aa, Homo Sapiens
MLSATDLGL

SEQ ID NO: 2718 - protein, 9 aa, Homo Sapiens
VTMLSIFWF

SEQ ID NO: 2719 - protein, 9 aa, Homo Sapiens
PLRYAMILT

SEQ ID NO: 2720 - protein, 9 aa, Homo Sapiens
CYHPDVMKL

SEQ ID NO: 2721 - protein, 9 aa, Homo Sapiens
SCTDTRINS

SEQ ID NO: 2722 - protein, 9 aa, Homo Sapiens
DTRINSAVG

SEQ ID NO: 2723 - protein, 9 aa, Homo Sapiens
LTAMFSTVG

SEQ ID NO: 2724 - protein, 9 aa, Homo Sapiens
VGVDLLLIL

SEQ ID NO: 2725 - protein, 9 aa, Homo Sapiens
LLSYVLIIR

SEQ ID NO: 2726 - protein, 9 aa, Homo Sapiens
LIIRTVLSV

SEQ ID NO: 2727 - protein, 9 aa, Homo Sapiens
RTVLSVASP

SEQ ID NO: 2728 - protein, 9 aa, Homo Sapiens
VASPEERKE

SEQ ID NO: 2729 - protein, 9 aa, Homo Sapiens
FSTCVSHIV

SEQ ID NO: 2730 - protein, 9 aa, Homo Sapiens
VSHIVAFAI

SEQ ID NO: 2731 - protein, 9 aa, Homo Sapiens
AIYYIPLIS

SEQ ID NO: 2732 - protein, 9 aa, Homo Sapiens
SIVHRFGKQ

SEQ ID NO: 2733 - protein, 9 aa, Homo Sapiens
HTMIANTYL

SEQ ID NO: 2734 - protein, 9 aa, Homo Sapiens
IANTYLLIS

SEQ ID NO: 2735 - protein, 9 aa, Homo Sapiens
PLMNPVIYS

SEQ ID NO: 2736 - protein, 9 aa, Homo Sapiens
KTKQIRRAV

SEQ ID NO: 2737 - protein, 9 aa, Homo Sapiens
QIRRAVIKI

SEQ ID NO: 2738 - protein, 9 aa, Homo Sapiens
LSATDLGLS

SEQ ID NO: 2739 - protein, 9 aa, Homo Sapiens
SSVLLAMAF

SEQ ID NO: 2740 - protein, 9 aa, Homo Sapiens
LRYAMILTD

SEQ ID NO: 2741 - protein, 9 aa, Homo Sapiens
ILTDSRIAQ

SEQ ID NO: 2742 - protein, 9 aa, Homo Sapiens
IRGLLMLTP

SEQ ID NO: 2743 - protein, 9 aa, Homo Sapiens
TPMVALLIR

SEQ ID NO: 2744 - protein, 9 aa, Homo Sapiens
YHPDVMKLS

SEQ ID NO: 2745 - protein, 9 aa, Homo Sapiens
NSAVGLTAM

SEQ ID NO: 2746 - protein, 9 aa, Homo Sapiens
ASPEERKET

SEQ ID NO: 2747 - protein, 9 aa, Homo Sapiens
ETFSTCVSH

SEQ ID NO: 2748 - protein, 9 aa, Homo Sapiens
AFAIYYIPL

SEQ ID NO: 2749 - protein, 9 aa, Homo Sapiens
PLISLSIVH

SEQ ID NO: 2750 - protein, 9 aa, Homo Sapiens
NTYLLISPL

SEQ ID NO: 2751 - protein, 9 aa, Homo Sapiens
ISPLMNPVI

SEQ ID NO: 2752 - protein, 9 aa, Homo Sapiens
LMNPVIYSV

SEQ ID NO: 2753 - protein, 9 aa, Homo Sapiens
YSVKTKQIR

SEQ ID NO: 2754 - protein, 9 aa, Homo Sapiens
SVKTKQIRR

SEQ ID NO: 2755 - protein, 9 aa, Homo Sapiens
RRAVIKILH

SEQ ID NO: 2756 - protein, 9 aa, Homo Sapiens
RAVIKILHS

SEQ ID NO: 2757 - protein, 9 aa, Homo Sapiens
TDLGLSIST

SEQ ID NO: 2758 - protein, 9 aa, Homo Sapiens
FFIKFFTVM

SEQ ID NO: 2759 - protein, 9 aa, Homo Sapiens
ESSVLLAMA

SEQ ID NO: 2760 - protein, 9 aa, Homo Sapiens
SRIAQIGVA

SEQ ID NO: 2761 - protein, 9 aa, Homo Sapiens
AQIGVASVI

SEQ ID NO: 2762 - protein, 9 aa, Homo Sapiens
IGVASVIRG

SEQ ID NO: 2763 - protein, 9 aa, Homo Sapiens
LSYCHSQVL

SEQ ID NO: 2764 - protein, 9 aa, Homo Sapiens
HSYCYHPDV

SEQ ID NO: 2765 - protein, 9 aa, Homo Sapiens
IYYIPLISL

SEQ ID NO: 2766 - protein, 9 aa, Homo Sapiens
ISLSIVHRF

SEQ ID NO: 2767 - protein, 9 aa, Homo Sapiens
SLSIVHRFG

SEQ ID NO: 2768 - protein, 9 aa, Homo Sapiens
LSIVHRFGK

SEQ ID NO: 2769 - protein, 9 aa, Homo Sapiens
AYVHTMIAN

SEQ ID NO: 2770 - protein, 9 aa, Homo Sapiens
ANTYLLISP

SEQ ID NO: 2771 - protein, 9 aa, Homo Sapiens
VIYSVKTKQ

SEQ ID NO: 2772 - protein, 9 aa, Homo Sapiens
LSMLSATDL

SEQ ID NO: 2773 - protein, 9 aa, Homo Sapiens
SMLSATDLG

SEQ ID NO: 2774 - protein, 9 aa, Homo Sapiens
LSISTLVTM

SEQ ID NO: 2775 - protein, 9 aa, Homo Sapiens
SISTLVTML

SEQ ID NO: 2776 - protein, 9 aa, Homo Sapiens
LVTMLSIFW

SEQ ID NO: 2777 - protein, 9 aa, Homo Sapiens
FWFNVREIS

SEQ ID NO: 2778 - protein, 9 aa, Homo Sapiens
WFNVREISF

SEQ ID NO: 2779 - protein, 9 aa, Homo Sapiens
CLSHMFFIK

SEQ ID NO: 2780 - protein, 9 aa, Homo Sapiens
LLAMAFDRF

SEQ ID NO: 2781 - protein, 9 aa, Homo Sapiens
FVAVSNPLR

SEQ ID NO: 2782 - protein, 9 aa, Homo Sapiens
VASVIRGLL

SEQ ID NO: 2783 - protein, 9 aa, Homo Sapiens
VIRGLLMLT

SEQ ID NO: 2784 - protein, 9 aa, Homo Sapiens
PMVALLIRL

SEQ ID NO: 2785 - protein, 9 aa, Homo Sapiens
SYCHSQVLH

SEQ ID NO: 2786 - protein, 9 aa, Homo Sapiens
YCYHPDVMK

SEQ ID NO: 2787 - protein, 9 aa, Homo Sapiens
LSCTDTRIN

SEQ ID NO: 2788 - protein, 9 aa, Homo Sapiens
SAVGLTAMF

SEQ ID NO: 2789 - protein, 9 aa, Homo Sapiens
GLTAMFSTV

SEQ ID NO: 2790 - protein, 9 aa, Homo Sapiens
YVLIIRTVL

SEQ ID NO: 2791 - protein, 9 aa, Homo Sapiens
VLIIRTVLS

SEQ ID NO: 2792 - protein, 9 aa, Homo Sapiens
LSVASPEER

SEQ ID NO: 2793 - protein, 9 aa, Homo Sapiens
FAIYYIPLI

SEQ ID NO: 2794 - protein, 9 aa, Homo Sapiens
KQAPAYVHT

SEQ ID NO: 2795 - protein, 9 aa, Homo Sapiens
APAYVHTMI

SEQ ID NO: 2796 - protein, 9 aa, Homo Sapiens
LISPLMNPV

SEQ ID NO: 2797 - protein, 9 aa, Homo Sapiens
TMLSIFWFN

SEQ ID NO: 2798 - protein, 9 aa, Homo Sapiens
SIFWFNVRE

SEQ ID NO: 2799 - protein, 9 aa, Homo Sapiens
MFFIKFFTV

SEQ ID NO: 2800 - protein, 9 aa, Homo Sapiens
AMAFDRFVA

SEQ ID NO: 2801 - protein, 9 aa, Homo Sapiens
MAFDRFVAV

SEQ ID NO: 2802 - protein, 9 aa, Homo Sapiens
FDRFVAVSN

SEQ ID NO: 2803 - protein, 9 aa, Homo Sapiens
SNPLRYAMI

SEQ ID NO: 2804 - protein, 9 aa, Homo Sapiens
IAQIGVASV

SEQ ID NO: 2805 - protein, 9 aa, Homo Sapiens
SYCYHPDVM

SEQ ID NO: 2806 - protein, 9 aa, Homo Sapiens
RINSAVGLT

SEQ ID NO: 2807 - protein, 9 aa, Homo Sapiens
AMFSTVGVD

SEQ ID NO: 2808 - protein, 9 aa, Homo Sapiens
MFSTVGVDL

SEQ ID NO: 2809 - protein, 9 aa, Homo Sapiens
IIRTVLSVA

SEQ ID NO: 2810 - protein, 9 aa, Homo Sapiens
SVASPEERK

SEQ ID NO: 2811 - protein, 9 aa, Homo Sapiens
ERKETFSTC

SEQ ID NO: 2812 - protein, 9 aa, Homo Sapiens
VHRFGKQAP

SEQ ID NO: 2813 - protein, 9 aa, Homo Sapiens
NPVIYSVKT

SEQ ID NO: 2814 - protein, 9 aa, Homo Sapiens
VKTKQIRRA

SEQ ID NO: 2815 - protein, 9 aa, Homo Sapiens
VIKILHSKE

SEQ ID NO: 2816 - protein, 9 aa, Homo Sapiens
MYYFLSMLS

SEQ ID NO: 2817 - protein, 9 aa, Homo Sapiens
YFLSMLSAT

SEQ ID NO: 2818 - protein, 9 aa, Homo Sapiens
FLSMLSATD

SEQ ID NO: 2819 - protein, 9 aa, Homo Sapiens
LGLSISTLV

SEQ ID NO: 2820 - protein, 9 aa, Homo Sapiens
EISFNACLS

SEQ ID NO: 2821 - protein, 9 aa, Homo Sapiens
SFNACLSHM

SEQ ID NO: 2822 - protein, 9 aa, Homo Sapiens
FNACLSHMF

SEQ ID NO: 2823 - protein, 9 aa, Homo Sapiens
SHMFFIKFF

SEQ ID NO: 2824 - protein, 9 aa, Homo Sapiens
FIKFFTVME

SEQ ID NO: 2825 - protein, 9 aa, Homo Sapiens
KFFTVMESS

SEQ ID NO: 2826 - protein, 9 aa, Homo Sapiens
TVMESSVLL

SEQ ID NO: 2827 - protein, 9 aa, Homo Sapiens
SVLLAMAFD

SEQ ID NO: 2828 - protein, 9 aa, Homo Sapiens
VLLAMAFDR

SEQ ID NO: 2829 - protein, 9 aa, Homo Sapiens
RFVAVSNPL

SEQ ID NO: 2830 - protein, 9 aa, Homo Sapiens
AVSNPLRYA

SEQ ID NO: 2831 - protein, 9 aa, Homo Sapiens
YAMILTDSR

SEQ ID NO: 2832 - protein, 9 aa, Homo Sapiens
GVASVIRGL

SEQ ID NO: 2833 - protein, 9 aa, Homo Sapiens
GLLMLTPMV

SEQ ID NO: 2834 - protein, 9 aa, Homo Sapiens
LLMLTPMVA

SEQ ID NO: 2835 - protein, 9 aa, Homo Sapiens
MVALLIRLS

SEQ ID NO: 2836 - protein, 9 aa, Homo Sapiens
ALLIRLSYC

SEQ ID NO: 2837 - protein, 9 aa, Homo Sapiens
CHSQVLHHS

SEQ ID NO: 2838 - protein, 9 aa, Homo Sapiens
SQVLHHSYC

SEQ ID NO: 2839 - protein, 9 aa, Homo Sapiens
VLHHSYCYH

SEQ ID NO: 2840 - protein, 9 aa, Homo Sapiens
LLILLSYVL

SEQ ID NO: 2841 - protein, 9 aa, Homo Sapiens
LILLSYVLI

SEQ ID NO: 2842 - protein, 9 aa, Homo Sapiens
SYVLIIRTV

SEQ ID NO: 2843 - protein, 9 aa, Homo Sapiens
TVLSVASPE

SEQ ID NO: 2844 - protein, 9 aa, Homo Sapiens
VLSVASPEE

SEQ ID NO: 2845 - protein, 9 aa, Homo Sapiens
GKQAPAYVH

SEQ ID NO: 2846 - protein, 9 aa, Homo Sapiens
QAPAYVHTM

SEQ ID NO: 2847 - protein, 9 aa, Homo Sapiens
YVHTMIANT

SEQ ID NO: 2848 - protein, 9 aa, Homo Sapiens
TMIANTYLL

SEQ ID NO: 2849 - protein, 9 aa, Homo Sapiens
TYLLISPLM

SEQ ID NO: 2850 - protein, 9 aa, Homo Sapiens
LLISPLMNP

SEQ ID NO: 2851 - protein, 9 aa, Homo Sapiens
TKQIRRAVI

SEQ ID NO: 2852 - protein, 9 aa, Homo Sapiens
IRRAVIKIL

SEQ ID NO: 2853 - protein, 9 aa, Homo Sapiens
DLGLSISTL

SEQ ID NO: 2854 - protein, 9 aa, Homo Sapiens
TLVTMLSIF

SEQ ID NO: 2855 - protein, 9 aa, Homo Sapiens
MLSIFWFNV

SEQ ID NO: 2856 - protein, 9 aa, Homo Sapiens
IFWFNVREI

SEQ ID NO: 2857 - protein, 9 aa, Homo Sapiens
FNVREISFN

SEQ ID NO: 2858 - protein, 9 aa, Homo Sapiens
REISFNACL

SEQ ID NO: 2859 - protein, 9 aa, Homo Sapiens
ACLSHMFFI

SEQ ID NO: 2860 - protein, 9 aa, Homo Sapiens
IKFFTVMES

SEQ ID NO: 2861 - protein, 9 aa, Homo Sapiens
FFTVMESSV

SEQ ID NO: 2862 - protein, 9 aa, Homo Sapiens
DRFVAVSNP

SEQ ID NO: 2863 - protein, 9 aa, Homo Sapiens
NPLRYAMIL

SEQ ID NO: 2864 - protein, 9 aa, Homo Sapiens
AMILTDSRI

SEQ ID NO: 2865 - protein, 9 aa, Homo Sapiens
RIAQIGVAS

SEQ ID NO: 2866 - protein, 9 aa, Homo Sapiens
LMLTPMVAL

SEQ ID NO: 2867 - protein, 9 aa, Homo Sapiens
LLIRLSYCH

SEQ ID NO: 2868 - protein, 9 aa, Homo Sapiens
IRLSYCHSQ

SEQ ID NO: 2869 - protein, 9 aa, Homo Sapiens
RLSYCHSQV

SEQ ID NO: 2870 - protein, 9 aa, Homo Sapiens
LHHSYCYHP

SEQ ID NO: 2871 - protein, 9 aa, Homo Sapiens
VMKLSCTDT

SEQ ID NO: 2872 - protein, 9 aa, Homo Sapiens
KLSCTDTRI

SEQ ID NO: 2873 - protein, 9 aa, Homo Sapiens
TDTRINSAV

SEQ ID NO: 2874 - protein, 9 aa, Homo Sapiens
AVGLTAMFS

SEQ ID NO: 2875 - protein, 9 aa, Homo Sapiens
VGLTAMFST

SEQ ID NO: 2876 - protein, 9 aa, Homo Sapiens
LLLILLSYV

SEQ ID NO: 2877 - protein, 9 aa, Homo Sapiens
KETFSTCVS

SEQ ID NO: 2878 - protein, 9 aa, Homo Sapiens
TFSTCVSHI

SEQ ID NO: 2879 - protein, 9 aa, Homo Sapiens
CVSHIVAFA

SEQ ID NO: 2880 - protein, 9 aa, Homo Sapiens
VAFAIYYIP

SEQ ID NO: 2881 - protein, 9 aa, Homo Sapiens
IVHRFGKQA

SEQ ID NO: 2882 - protein, 9 aa, Homo Sapiens
HRFGKQAPA

SEQ ID NO: 2883 - protein, 9 aa, Homo Sapiens
FGKQAPAYV

SEQ ID NO: 2884 - protein, 9 aa, Homo Sapiens
MNPVIYSVK

SEQ ID NO: 2885 - protein, 9 aa, Homo Sapiens
PVIYSVKTK

SEQ ID NO: 2886 - protein, 9 aa, Homo Sapiens
AVIKILHSK

SEQ ID NO: 2887 - protein, 9 aa, Homo Sapiens
DLLLILLSY

SEQ ID NO: 2888 - protein, 9 aa, Homo Sapiens
DLGLSISTL

SEQ ID NO: 2889 - protein, 9 aa, Homo Sapiens
VTMLSIFWF

SEQ ID NO: 2890 - protein, 9 aa, Homo Sapiens
GVASVIRGL

SEQ ID NO: 2891 - protein, 9 aa, Homo Sapiens
SVIRGLLML

SEQ ID NO: 2892 - protein, 9 aa, Homo Sapiens
SISTLVTML

SEQ ID NO: 2893 - protein, 9 aa, Homo Sapiens
LLAMAFDRF

SEQ ID NO: 2894 - protein, 9 aa, Homo Sapiens
GVDLLLILL

SEQ ID NO: 2895 - protein, 9 aa, Homo Sapiens
NTYLLISPL

SEQ ID NO: 2896 - protein, 9 aa, Homo Sapiens
TLVTMLSIF

SEQ ID NO: 2897 - protein, 9 aa, Homo Sapiens
MLTPMVALL

SEQ ID NO: 2898 - protein, 9 aa, Homo Sapiens
TVMESSVLL

SEQ ID NO: 2899 - protein, 9 aa, Homo Sapiens
FFIKFFTVM

SEQ ID NO: 2900 - protein, 9 aa, Homo Sapiens
ETFSTCVSH

SEQ ID NO: 2901 - protein, 9 aa, Homo Sapiens
SFNACLSHM

SEQ ID NO: 2902 - protein, 9 aa, Homo Sapiens
QVLHHSYCY

SEQ ID NO: 2903 - protein, 9 aa, Homo Sapiens
STVGVDLLL

SEQ ID NO: 2904 - protein, 9 aa, Homo Sapiens
HIVAFAIYY

SEQ ID NO: 2905 - protein, 9 aa, Homo Sapiens
RFGKQAPAY

SEQ ID NO: 2906 - protein, 9 aa, Homo Sapiens
FTVMESSVL

SEQ ID NO: 2907 - protein, 9 aa, Homo Sapiens
LLILLSYVL

SEQ ID NO: 2908 - protein, 9 aa, Homo Sapiens
AFAIYYIPL

SEQ ID NO: 2909 - protein, 9 aa, Homo Sapiens
LTDSRIAQI

SEQ ID NO: 2910 - protein, 9 aa, Homo Sapiens
VIRGLLMLT

SEQ ID NO: 2911 - protein, 9 aa, Homo Sapiens
DVMKLSCTD

SEQ ID NO: 2912 - protein, 9 aa, Homo Sapiens
YVLIIRTVL

SEQ ID NO: 2913 - protein, 9 aa, Homo Sapiens
HTMIANTYL

SEQ ID NO: 2914 - protein, 9 aa, Homo Sapiens
AVIKILHSK

SEQ ID NO: 2915 - protein, 9 aa, Homo Sapiens
MLSATDLGL

SEQ ID NO: 2916 - protein, 9 aa, Homo Sapiens
WFNVREISF

SEQ ID NO: 2917 - protein, 9 aa, Homo Sapiens
DTRINSAVG

SEQ ID NO: 2918 - protein, 9 aa, Homo Sapiens
LIIRTVLSV

SEQ ID NO: 2919 - protein, 9 aa, Homo Sapiens
RTVLSVASP

SEQ ID NO: 2920 - protein, 9 aa, Homo Sapiens
TCVSHIVAF

SEQ ID NO: 2921 - protein, 9 aa, Homo Sapiens
SHIVAFAIY

SEQ ID NO: 2922 - protein, 9 aa, Homo Sapiens
LISLSIVHR

SEQ ID NO: 2923 - protein, 9 aa, Homo Sapiens
LLISPLMNP

SEQ ID NO: 2924 - protein, 9 aa, Homo Sapiens
LISPLMNPV

SEQ ID NO: 2925 - protein, 9 aa, Homo Sapiens
PVIYSVKTK

SEQ ID NO: 2926 - protein, 9 aa, Homo Sapiens
ATDLGLSIS

SEQ ID NO: 2927 - protein, 9 aa, Homo Sapiens
LSISTLVTM

SEQ ID NO: 2928 - protein, 9 aa, Homo Sapiens
EISFNACLS

SEQ ID NO: 2929 - protein, 9 aa, Homo Sapiens
MVALLIRLS

SEQ ID NO: 2930 - protein, 9 aa, Homo Sapiens
LIRLSYCHS

SEQ ID NO: 2931 - protein, 9 aa, Homo Sapiens
CYHPDVMKL

SEQ ID NO: 2932 - protein, 9 aa, Homo Sapiens
CTDTRINSA

SEQ ID NO: 2933 - protein, 9 aa, Homo Sapiens
LILLSYVLI

SEQ ID NO: 2934 - protein, 9 aa, Homo Sapiens
ISLSIVHRF

SEQ ID NO: 2935 - protein, 9 aa, Homo Sapiens
YVHTMIANT

SEQ ID NO: 2936 - protein, 9 aa, Homo Sapiens
STLVTMLSI

SEQ ID NO: 2937 - protein, 9 aa, Homo Sapiens
LSHMFFIKF

SEQ ID NO: 2938 - protein, 9 aa, Homo Sapiens
SVLLAMAFD

SEQ ID NO: 2939 - protein, 9 aa, Homo Sapiens
RINSAVGLT

SEQ ID NO: 2940 - protein, 9 aa, Homo Sapiens
SAVGLTAMF

SEQ ID NO: 2941 - protein, 9 aa, Homo Sapiens
MFSTVGVDL

SEQ ID NO: 2942 - protein, 9 aa, Homo Sapiens
IIRTVLSVA

SEQ ID NO: 2943 - protein, 9 aa, Homo Sapiens
CVSHIVAFA

SEQ ID NO: 2944 - protein, 9 aa, Homo Sapiens
IVAFAIYYI

SEQ ID NO: 2945 - protein, 9 aa, Homo Sapiens
SIVHRFGKQ

SEQ ID NO: 2946 - protein, 9 aa, Homo Sapiens
MIANTYLLI

SEQ ID NO: 2947 - protein, 9 aa, Homo Sapiens
QIRRAVIKI

SEQ ID NO: 2948 - protein, 9 aa, Homo Sapiens
SIFWFNVRE

SEQ ID NO: 2949 - protein, 9 aa, Homo Sapiens
SHMFFIKFF

SEQ ID NO: 2950 - protein, 9 aa, Homo Sapiens
MESSVLLAM

SEQ ID NO: 2951 - protein, 9 aa, Homo Sapiens
DRFVAVSNP

SEQ ID NO: 2952 - protein, 9 aa, Homo Sapiens
RFVAVSNPL

SEQ ID NO: 2953 - protein, 9 aa, Homo Sapiens
AVSNPLRYA

SEQ ID NO: 2954 - protein, 9 aa, Homo Sapiens
RIAQIGVAS

SEQ ID NO: 2955 - protein, 9 aa, Homo Sapiens
LMLTPMVAL

SEQ ID NO: 2956 - protein, 9 aa, Homo Sapiens
PMVALLIRL

SEQ ID NO: 2957 - protein, 9 aa, Homo Sapiens
NSAVGLTAM

SEQ ID NO: 2958 - protein, 9 aa, Homo Sapiens
TVGVDLLLI

SEQ ID NO: 2959 - protein, 9 aa, Homo Sapiens
VGVDLLLIL

SEQ ID NO: 2960 - protein, 9 aa, Homo Sapiens
LLLILLSYV

SEQ ID NO: 2961 - protein, 9 aa, Homo Sapiens
ERKETFSTC

SEQ ID NO: 2962 - protein, 9 aa, Homo Sapiens
VIKILHSKE

SEQ ID NO: 2963 - protein, 9 aa, Homo Sapiens
YFLSMLSAT

SEQ ID NO: 2964 - protein, 9 aa, Homo Sapiens
NVREISFNA

SEQ ID NO: 2965 - protein, 9 aa, Homo Sapiens
FNACLSHMF

SEQ ID NO: 2966 - protein, 9 aa, Homo Sapiens
MFFIKFFTV

SEQ ID NO: 2967 - protein, 9 aa, Homo Sapiens
FIKFFTVME

SEQ ID NO: 2968 - protein, 9 aa, Homo Sapiens
KFFTVMESS

SEQ ID NO: 2969 - protein, 9 aa, Homo Sapiens
ESSVLLAMA

SEQ ID NO: 2970 - protein, 9 aa, Homo Sapiens
SSVLLAMAF

SEQ ID NO: 2971 - protein, 9 aa, Homo Sapiens
FVAVSNPLR

SEQ ID NO: 2972 - protein, 9 aa, Homo Sapiens
ALLIRLSYC

SEQ ID NO: 2973 - protein, 9 aa, Homo Sapiens
VLHHSYCYH

SEQ ID NO: 2974 - protein, 9 aa, Homo Sapiens
TRINSAVGL

SEQ ID NO: 2975 - protein, 9 aa, Homo Sapiens
GLTAMFSTV

SEQ ID NO: 2976 - protein, 9 aa, Homo Sapiens
ILLSYVLII

SEQ ID NO: 2977 - protein, 9 aa, Homo Sapiens
SVASPEERK

SEQ ID NO: 2978 - protein, 9 aa, Homo Sapiens
IYYIPLISL

SEQ ID NO: 2979 - protein, 9 aa, Homo Sapiens
QAPAYVHTM

SEQ ID NO: 2980 - protein, 9 aa, Homo Sapiens
SVKTKQIRR

SEQ ID NO: 2981 - protein, 9 aa, Homo Sapiens
KTKQIRRAV

SEQ ID NO: 2982 - protein, 9 aa, Homo Sapiens
REISFNACL

SEQ ID NO: 2983 - protein, 9 aa, Homo Sapiens
NACLSHMFF

SEQ ID NO: 2984 - protein, 9 aa, Homo Sapiens
CLSHMFFIK

SEQ ID NO: 2985 - protein, 9 aa, Homo Sapiens
AFDRFVAVS

SEQ ID NO: 2986 - protein, 9 aa, Homo Sapiens
VAVSNPLRY

SEQ ID NO: 2987 - protein, 9 aa, Homo Sapiens
VSNPLRYAM

SEQ ID NO: 2988 - protein, 9 aa, Homo Sapiens
PLRYAMILT

SEQ ID NO: 2989 - protein, 9 aa, Homo Sapiens
RGLLMLTPM

SEQ ID NO: 2990 - protein, 9 aa, Homo Sapiens
HSQVLHHSY

SEQ ID NO: 2991 - protein, 9 aa, Homo Sapiens
FSTVGVDLL

SEQ ID NO: 2992 - protein, 9 aa, Homo Sapiens
LLSYVLIIR

SEQ ID NO: 2993 - protein, 9 aa, Homo Sapiens
TVLSVASPE

SEQ ID NO: 2994 - protein, 9 aa, Homo Sapiens
SPEERKETF

SEQ ID NO: 2995 - protein, 9 aa, Homo Sapiens
TFSTCVSHI

SEQ ID NO: 2996 - protein, 9 aa, Homo Sapiens
YIPLISLSI

SEQ ID NO: 2997 - protein, 9 aa, Homo Sapiens
PLISLSIVH

SEQ ID NO: 2998 - protein, 9 aa, Homo Sapiens
PLMNPVIYS

SEQ ID NO: 2999 - protein, 9 aa, Homo Sapiens
VIYSVKTKQ

SEQ ID NO: 3000 - protein, 9 aa, Homo Sapiens
IRRAVIKIL

SEQ ID NO: 3001 - protein, 9 aa, Homo Sapiens
LVTMLSIFW

SEQ ID NO: 3002 - protein, 9 aa, Homo Sapiens
IFWFNVREI

SEQ ID NO: 3003 - protein, 9 aa, Homo Sapiens
ILTDSRIAQ

SEQ ID NO: 3004 - protein, 9 aa, Homo Sapiens
QIGVASVIR

SEQ ID NO: 3005 - protein, 9 aa, Homo Sapiens
GLLMLTPMV

SEQ ID NO: 3006 - protein, 9 aa, Homo Sapiens
LTPMVALLI

SEQ ID NO: 3007 - protein, 9 aa, Homo Sapiens
VALLIRLSY

SEQ ID NO: 3008 - protein, 9 aa, Homo Sapiens
LLIRLSYCH

SEQ ID NO: 3009 - protein, 9 aa, Homo Sapiens
AVGLTAMFS

SEQ ID NO: 3010 - protein, 9 aa, Homo Sapiens
LTAMFSTVG

SEQ ID NO: 3011 - protein, 9 aa, Homo Sapiens
VLIIRTVLS

SEQ ID NO: 3012 - protein, 9 aa, Homo Sapiens
STCVSHIVA

SEQ ID NO: 3013 - protein, 9 aa, Homo Sapiens
IVHRFGKQA

SEQ ID NO: 3014 - protein, 9 aa, Homo Sapiens
SPLMNPVIY

SEQ ID NO: 3015 - protein, 9 aa, Homo Sapiens
FLSMLSATD

SEQ ID NO: 3016 - protein, 9 aa, Homo Sapiens
MILTDSRIA

SEQ ID NO: 3017 - protein, 9 aa, Homo Sapiens
RLSYCHSQV

SEQ ID NO: 3018 - protein, 9 aa, Homo Sapiens
VLSVASPEE

SEQ ID NO: 3019 - protein, 9 aa, Homo Sapiens
AIYYIPLIS

SEQ ID NO: 3020 - protein, 9 aa, Homo Sapiens
YYIPLISLS

SEQ ID NO: 3021 - protein, 9 aa, Homo Sapiens
VHTMIANTY

SEQ ID NO: 3022 - protein, 9 aa, Homo Sapiens
TMIANTYLL

SEQ ID NO: 3023 - protein, 9 aa, Homo Sapiens
YLLISPLMN

SEQ ID NO: 3024 - protein, 9 aa, Homo Sapiens
LSMLSATDL

SEQ ID NO: 3025 - protein, 9 aa, Homo Sapiens
GLSISTLVT

SEQ ID NO: 3026 - protein, 9 aa, Homo Sapiens
MLSIFWFNV

SEQ ID NO: 3027 - protein, 9 aa, Homo Sapiens
MAFDRFVAV

SEQ ID NO: 3028 - protein, 9 aa, Homo Sapiens
NPLRYAMIL

SEQ ID NO: 3029 - protein, 9 aa, Homo Sapiens
LLMLTPMVA

SEQ ID NO: 3030 - protein, 9 aa, Homo Sapiens
LSYCHSQVL

SEQ ID NO: 3031 - protein, 9 aa, Homo Sapiens
KLSCTDTRI

SEQ ID NO: 3032 - protein, 9 aa, Homo Sapiens
KQAPAYVHT

SEQ ID NO: 3033 - protein, 9 aa, Homo Sapiens
TYLLISPLM

SEQ ID NO: 3034 - protein, 9 aa, Homo Sapiens
YYFLSMLSA

SEQ ID NO: 3035 - protein, 9 aa, Homo Sapiens
IKFFTVMES

SEQ ID NO: 3036 - protein, 9 aa, Homo Sapiens
FFTVMESSV

SEQ ID NO: 3037 - protein, 9 aa, Homo Sapiens
VLLAMAFDR

SEQ ID NO: 3038 - protein, 9 aa, Homo Sapiens
VASVIRGLL

SEQ ID NO: 3039 - protein, 9 aa, Homo Sapiens
ASVIRGLLM

SEQ ID NO: 3040 - protein, 9 aa, Homo Sapiens
SYCYHPDVM

SEQ ID NO: 3041 - protein, 9 aa, Homo Sapiens
EERKETFST

SEQ ID NO: 3042 - protein, 9 aa, Homo Sapiens
SLSIVHRFG

SEQ ID NO: 3043 - protein, 9 aa, Homo Sapiens
SNPLRYAMI

SEQ ID NO: 3044 - protein, 9 aa, Homo Sapiens
DSRIAQIGV

SEQ ID NO: 3045 - protein, 9 aa, Homo Sapiens
SRIAQIGVA

SEQ ID NO: 3046 - protein, 9 aa, Homo Sapiens
YCHSQVLHH

SEQ ID NO: 3047 - protein, 9 aa, Homo Sapiens
AMFSTVGVD

SEQ ID NO: 3048 - protein, 9 aa, Homo Sapiens
FAIYYIPLI

SEQ ID NO: 3049 - protein, 9 aa, Homo Sapiens
LMNPVIYSV

SEQ ID NO: 3050 - protein, 9 aa, Homo Sapiens
VKTKQIRRA

SEQ ID NO: 3051 - protein, 9 aa, Homo Sapiens
LSIFWFNVR

SEQ ID NO: 3052 - protein, 9 aa, Homo Sapiens
VREISFNAC

SEQ ID NO: 3053 - protein, 9 aa, Homo Sapiens
VMESSVLLA

SEQ ID NO: 3054 - protein, 9 aa, Homo Sapiens
IAQIGVASV

SEQ ID NO: 3055 - protein, 9 aa, Homo Sapiens
IGVASVIRG

SEQ ID NO: 3056 - protein, 9 aa, Homo Sapiens
CHSQVLHHS

SEQ ID NO: 3057 - protein, 9 aa, Homo Sapiens
YHPDVMKLS

SEQ ID NO: 3058 - protein, 9 aa, Homo Sapiens
PDVMKLSCT

SEQ ID NO: 3059 - protein, 9 aa, Homo Sapiens
LSYVLIIRT

SEQ ID NO: 3060 - protein, 9 aa, Homo Sapiens
VAFAIYYIP

SEQ ID NO: 3061 - protein, 9 aa, Homo Sapiens
IPLISLSIV

SEQ ID NO: 3062 - protein, 9 aa, Homo Sapiens
HRFGKQAPA

SEQ ID NO: 3063 - protein, 9 aa, Homo Sapiens
ANTYLLISP

SEQ ID NO: 3064 - protein, 9 aa, Homo Sapiens
MNPVIYSVK

SEQ ID NO: 3065 - protein, 9 aa, Homo Sapiens
RAVIKILHS

SEQ ID NO: 3066 - protein, 9 aa, Homo Sapiens
LSATDLGLS

SEQ ID NO: 3067 - protein, 9 aa, Homo Sapiens
TMLSIFWFN

SEQ ID NO: 3068 - protein, 9 aa, Homo Sapiens
FNVREISFN

SEQ ID NO: 3069 - protein, 9 aa, Homo Sapiens
ACLSHMFFI

SEQ ID NO: 3070 - protein, 9 aa, Homo Sapiens
RYAMILTDS

SEQ ID NO: 3071 - protein, 9 aa, Homo Sapiens
AQIGVASVI

SEQ ID NO: 3072 - protein, 9 aa, Homo Sapiens
IRGLLMLTP

SEQ ID NO: 3073 - protein, 9 aa, Homo Sapiens
VGLTAMFST

SEQ ID NO: 3074 - protein, 9 aa, Homo Sapiens
VDLLLILLS

SEQ ID NO: 3075 - protein, 9 aa, Homo Sapiens
AYVHTMIAN

SEQ ID NO: 3076 - protein, 9 aa, Homo Sapiens
TDLGLSIST

SEQ ID NO: 3077 - protein, 9 aa, Homo Sapiens
LRYAMILTD

SEQ ID NO: 3078 - protein, 9 aa, Homo Sapiens
AMILTDSRI

SEQ ID NO: 3079 - protein, 9 aa, Homo Sapiens
TPMVALLIR

SEQ ID NO: 3080 - protein, 9 aa, Homo Sapiens
HHSYCYHPD

SEQ ID NO: 3081 - protein, 9 aa, Homo Sapiens
SYVLIIRTV

SEQ ID NO: 3082 - protein, 9 aa, Homo Sapiens
ASPEERKET

SEQ ID NO: 3083 - protein, 9 aa, Homo Sapiens
IANTYLLIS

SEQ ID NO: 3084 - protein, 9 aa, Homo Sapiens
SATDLGLSI

SEQ ID NO: 3085 - protein, 9 aa, Homo Sapiens
ISFNACLSH

SEQ ID NO: 3086 - protein, 9 aa, Homo Sapiens
TAMFSTVGV

SEQ ID NO: 3087 - protein, 9 aa, Homo Sapiens
IRTVLSVAS

SEQ ID NO: 3088 - protein, 9 aa, Homo Sapiens
VASPEERKE

SEQ ID NO: 3089 - protein, 9 aa, Homo Sapiens
LSIVHRFGK

SEQ ID NO: 3090 - protein, 9 aa, Homo Sapiens
FGKQAPAYV

SEQ ID NO: 3091 - protein, 9 aa, Homo Sapiens
KQIRRAVIK

SEQ ID NO: 3092 - protein, 9 aa, Homo Sapiens
IKILHSKET

SEQ ID NO: 3093 - protein, 9 aa, Homo Sapiens
MYYFLSMLS

SEQ ID NO: 3094 - protein, 9 aa, Homo Sapiens
FWFNVREIS

SEQ ID NO: 3095 - protein, 9 aa, Homo Sapiens
HMFFIKFFT

SEQ ID NO: 3096 - protein, 9 aa, Homo Sapiens
FDRFVAVSN

SEQ ID NO: 3097 - protein, 9 aa, Homo Sapiens
YAMILTDSR

SEQ ID NO: 3098 - protein, 9 aa, Homo Sapiens
IRLSYCHSQ

SEQ ID NO: 3099 - protein, 9 aa, Homo Sapiens
SYCHSQVLH

SEQ ID NO: 3100 - protein, 9 aa, Homo Sapiens
LHHSYCYHP

SEQ ID NO: 3101 - protein, 9 aa, Homo Sapiens
YCYHPDVMK

SEQ ID NO: 3102 - protein, 9 aa, Homo Sapiens
HPDVMKLSC

SEQ ID NO: 3103 - protein, 9 aa, Homo Sapiens
VMKLSCTDT

SEQ ID NO: 3104 - protein, 9 aa, Homo Sapiens
SCTDTRINS

SEQ ID NO: 3105 - protein, 9 aa, Homo Sapiens
TDTRINSAV

SEQ ID NO: 3106 - protein, 9 aa, Homo Sapiens
LSVASPEER

SEQ ID NO: 3107 - protein, 9 aa, Homo Sapiens
VHRFGKQAP

SEQ ID NO: 3108 - protein, 9 aa, Homo Sapiens
APAYVHTMI

SEQ ID NO: 3109 - protein, 9 aa, Homo Sapiens
ISPLMNPVI

SEQ ID NO: 3110 - protein, 9 aa, Homo Sapiens
NPVIYSVKT

SEQ ID NO: 3111 - protein, 9 aa, Homo Sapiens
IYSVKTKQI

SEQ ID NO: 3112 - protein, 9 aa, Homo Sapiens
YSVKTKQIR

SEQ ID NO: 3113 - protein, 9 aa, Homo Sapiens
SMLSATDLG

SEQ ID NO: 3114 - protein, 9 aa, Homo Sapiens
LGLSISTLV

SEQ ID NO: 3115 - protein, 9 aa, Homo Sapiens
ISTLVTMLS

SEQ ID NO: 3116 - protein, 9 aa, Homo Sapiens
AMAFDRFVA

SEQ ID NO: 3117 - protein, 9 aa, Homo Sapiens
TDSRIAQIG

SEQ ID NO: 3118 - protein, 9 aa, Homo Sapiens
SQVLHHSYC

SEQ ID NO: 3119 - protein, 9 aa, Homo Sapiens
HSYCYHPDV

SEQ ID NO: 3120 - protein, 9 aa, Homo Sapiens
MKLSCTDTR

SEQ ID NO: 3121 - protein, 9 aa, Homo Sapiens
PEERKETFS

SEQ ID NO: 3122 - protein, 9 aa, Homo Sapiens
KETFSTCVS

SEQ ID NO: 3123 - protein, 9 aa, Homo Sapiens
VSHIVAFAI

SEQ ID NO: 3124 - protein, 9 aa, Homo Sapiens
PAYVHTMIA

SEQ ID NO: 3125 - protein, 9 aa, Homo Sapiens
TKQIRRAVI

SEQ ID NO: 3126 - protein, 9 aa, Homo Sapiens
RRAVIKILH

SEQ ID NO: 3127 - protein, 9 aa, Homo Sapiens
KQIRRAVIK

SEQ ID NO: 3128 - protein, 9 aa, Homo Sapiens
AVIKILHSK

SEQ ID NO: 3129 - protein, 9 aa, Homo Sapiens
PVIYSVKTK

SEQ ID NO: 3130 - protein, 9 aa, Homo Sapiens
DLLLILLSY

SEQ ID NO: 3131 - protein, 9 aa, Homo Sapiens
SVIRGLLML

SEQ ID NO: 3132 - protein, 9 aa, Homo Sapiens
SVASPEERK

SEQ ID NO: 3133 - protein, 9 aa, Homo Sapiens
VLLAMAFDR

SEQ ID NO: 3134 - protein, 9 aa, Homo Sapiens
RIAQIGVAS

SEQ ID NO: 3135 - protein, 9 aa, Homo Sapiens
ALLIRLSYC

SEQ ID NO: 3136 - protein, 9 aa, Homo Sapiens
IIRTVLSVA

SEQ ID NO: 3137 - protein, 9 aa, Homo Sapiens
PLISLSIVH

SEQ ID NO: 3138 - protein, 9 aa, Homo Sapiens
IVHRFGKQA

SEQ ID NO: 3139 - protein, 9 aa, Homo Sapiens
CLSHMFFIK

SEQ ID NO: 3140 - protein, 9 aa, Homo Sapiens
LLIRLSYCH

SEQ ID NO: 3141 - protein, 9 aa, Homo Sapiens
RLSYCHSQV

SEQ ID NO: 3142 - protein, 9 aa, Homo Sapiens
QVLHHSYCY

SEQ ID NO: 3143 - protein, 9 aa, Homo Sapiens
VLIIRTVLS

SEQ ID NO: 3144 - protein, 9 aa, Homo Sapiens
AQIGVASVI

SEQ ID NO: 3145 - protein, 9 aa, Homo Sapiens
YCYHPDVMK

SEQ ID NO: 3146 - protein, 9 aa, Homo Sapiens
GLTAMFSTV

SEQ ID NO: 3147 - protein, 9 aa, Homo Sapiens
YVLIIRTVL

SEQ ID NO: 3148 - protein, 9 aa, Homo Sapiens
LIIRTVLSV

SEQ ID NO: 3149 - protein, 9 aa, Homo Sapiens
TVLSVASPE

SEQ ID NO: 3150 - protein, 9 aa, Homo Sapiens
HIVAFAIYY

SEQ ID NO: 3151 - protein, 9 aa, Homo Sapiens
AIYYIPLIS

SEQ ID NO: 3152 - protein, 9 aa, Homo Sapiens
DLGLSISTL

SEQ ID NO: 3153 - protein, 9 aa, Homo Sapiens
GLSISTLVT

SEQ ID NO: 3154 - protein, 9 aa, Homo Sapiens
QIGVASVIR

SEQ ID NO: 3155 - protein, 9 aa, Homo Sapiens
AVGLTAMFS

SEQ ID NO: 3156 - protein, 9 aa, Homo Sapiens
LLILLSYVL

SEQ ID NO: 3157 - protein, 9 aa, Homo Sapiens
YLLISPLMN

SEQ ID NO: 3158 - protein, 9 aa, Homo Sapiens
FLSMLSATD

SEQ ID NO: 3159 - protein, 9 aa, Homo Sapiens
TLVTMLSIF

SEQ ID NO: 3160 - protein, 9 aa, Homo Sapiens
SVLLAMAFD

SEQ ID NO: 3161 - protein, 9 aa, Homo Sapiens
LLMLTPMVA

SEQ ID NO: 3162 - protein, 9 aa, Homo Sapiens
ILLSYVLII

SEQ ID NO: 3163 - protein, 9 aa, Homo Sapiens
LISLSIVHR

SEQ ID NO: 3164 - protein, 9 aa, Homo Sapiens
MNPVIYSVK

SEQ ID NO: 3165 - protein, 9 aa, Homo Sapiens
SVKTKQIRR

SEQ ID NO: 3166 - protein, 9 aa, Homo Sapiens
MLTPMVALL

SEQ ID NO: 3167 - protein, 9 aa, Homo Sapiens
LLLILLSYV

SEQ ID NO: 3168 - protein, 9 aa, Homo Sapiens
QIRRAVIKI

SEQ ID NO: 3169 - protein, 9 aa, Homo Sapiens
MLSATDLGL

SEQ ID NO: 3170 - protein, 9 aa, Homo Sapiens
TVMESSVLL

SEQ ID NO: 3171 - protein, 9 aa, Homo Sapiens
LLAMAFDRF

SEQ ID NO: 3172 - protein, 9 aa, Homo Sapiens
FVAVSNPLR

SEQ ID NO: 3173 - protein, 9 aa, Homo Sapiens
ILTDSRIAQ

SEQ ID NO: 3174 - protein, 9 aa, Homo Sapiens
VALLIRLSY

SEQ ID NO: 3175 - protein, 9 aa, Homo Sapiens
INSAVGLTA

SEQ ID NO: 3176 - protein, 9 aa, Homo Sapiens
LILLSYVLI

SEQ ID NO: 3177 - protein, 9 aa, Homo Sapiens
LLSYVLIIR

SEQ ID NO: 3178 - protein, 9 aa, Homo Sapiens
NVREISFNA

SEQ ID NO: 3179 - protein, 9 aa, Homo Sapiens
FIKFFTVME

SEQ ID NO: 3180 - protein, 9 aa, Homo Sapiens
AVSNPLRYA

SEQ ID NO: 3181 - protein, 9 aa, Homo Sapiens
VIRGLLMLT

SEQ ID NO: 3182 - protein, 9 aa, Homo Sapiens
VLHHSYCYH

SEQ ID NO: 3183 - protein, 9 aa, Homo Sapiens
DVMKLSCTD

SEQ ID NO: 3184 - protein, 9 aa, Homo Sapiens
KLSCTDTRI

SEQ ID NO: 3185 - protein, 9 aa, Homo Sapiens
YIPLISLSI

SEQ ID NO: 3186 - protein, 9 aa, Homo Sapiens
LSIVHRFGK

SEQ ID NO: 3187 - protein, 9 aa, Homo Sapiens
RFGKQAPAY

SEQ ID NO: 3188 - protein, 9 aa, Homo Sapiens
LLISPLMNP

SEQ ID NO: 3189 - protein, 9 aa, Homo Sapiens
SPLMNPVIY

SEQ ID NO: 3190 - protein, 9 aa, Homo Sapiens
VIYSVKTKQ

SEQ ID NO: 3191 - protein, 9 aa, Homo Sapiens
SIFWFNVRE

SEQ ID NO: 3192 - protein, 9 aa, Homo Sapiens
AFDRFVAVS

SEQ ID NO: 3193 - protein, 9 aa, Homo Sapiens
FDRFVAVSN

SEQ ID NO: 3194 - protein, 9 aa, Homo Sapiens
PLRYAMILT

SEQ ID NO: 3195 - protein, 9 aa, Homo Sapiens
LRYAMILTD

SEQ ID NO: 3196 - protein, 9 aa, Homo Sapiens
GLLMLTPMV

SEQ ID NO: 3197 - protein, 9 aa, Homo Sapiens
RINSAVGLT

SEQ ID NO: 3198 - protein, 9 aa, Homo Sapiens
TVGVDLLLI

SEQ ID NO: 3199 - protein, 9 aa, Homo Sapiens
CVSHIVAFA

SEQ ID NO: 3200 - protein, 9 aa, Homo Sapiens
SHIVAFAIY

SEQ ID NO: 3201 - protein, 9 aa, Homo Sapiens
IVAFAIYYI

SEQ ID NO: 3202 - protein, 9 aa, Homo Sapiens
SLSIVHRFG

SEQ ID NO: 3203 - protein, 9 aa, Homo Sapiens
GKQAPAYVH

SEQ ID NO: 3204 - protein, 9 aa, Homo Sapiens
YVHTMIANT

SEQ ID NO: 3205 - protein, 9 aa, Homo Sapiens
VHTMIANTY

SEQ ID NO: 3206 - protein, 9 aa, Homo Sapiens
MIANTYLLI

SEQ ID NO: 3207 - protein, 9 aa, Homo Sapiens
VIKILHSKE

SEQ ID NO: 3208 - protein, 9 aa, Homo Sapiens
ISFNACLSH

SEQ ID NO: 3209 - protein, 9 aa, Homo Sapiens
GVASVIRGL

SEQ ID NO: 3210 - protein, 9 aa, Homo Sapiens
ASVIRGLLM

SEQ ID NO: 3211 - protein, 9 aa, Homo Sapiens
MVALLIRLS

SEQ ID NO: 3212 - protein, 9 aa, Homo Sapiens
LIRLSYCHS

SEQ ID NO: 3213 - protein, 9 aa, Homo Sapiens
SPEERKETF

SEQ ID NO: 3214 - protein, 9 aa, Homo Sapiens
SIVHRFGKQ

SEQ ID NO: 3215 - protein, 9 aa, Homo Sapiens
LSISTLVTM

SEQ ID NO: 3216 - protein, 9 aa, Homo Sapiens
SISTLVTML

SEQ ID NO: 3217 - protein, 9 aa, Homo Sapiens
MLSIFWFNV

SEQ ID NO: 3218 - protein, 9 aa, Homo Sapiens
LSIFWFNVR

SEQ ID NO: 3219 - protein, 9 aa, Homo Sapiens
EISFNACLS

SEQ ID NO: 3220 - protein, 9 aa, Homo Sapiens
SSVLLAMAF

SEQ ID NO: 3221 - protein, 9 aa, Homo Sapiens
SRIAQIGVA

SEQ ID NO: 3222 - protein, 9 aa, Homo Sapiens
DTRINSAVG

SEQ ID NO: 3223 - protein, 9 aa, Homo Sapiens
TRINSAVGL

SEQ ID NO: 3224 - protein, 9 aa, Homo Sapiens
SAVGLTAMF

SEQ ID NO: 3225 - protein, 9 aa, Homo Sapiens
GVDLLLILL

SEQ ID NO: 3226 - protein, 9 aa, Homo Sapiens
KQAPAYVHT

SEQ ID NO: 3227 - protein, 9 aa, Homo Sapiens
LISPLMNPV

SEQ ID NO: 3228 - protein, 9 aa, Homo Sapiens
PLMNPVIYS

SEQ ID NO: 3229 - protein, 9 aa, Homo Sapiens
TKQIRRAVI

SEQ ID NO: 3230 - protein, 9 aa, Homo Sapiens
SATDLGLSI

SEQ ID NO: 3231 - protein, 9 aa, Homo Sapiens
LVTMLSIFW

SEQ ID NO: 3232 - protein, 9 aa, Homo Sapiens
REISFNACL

SEQ ID NO: 3233 - protein, 9 aa, Homo Sapiens
VAVSNPLRY

SEQ ID NO: 3234 - protein, 9 aa, Homo Sapiens
AMILTDSRI

SEQ ID NO: 3235 - protein, 9 aa, Homo Sapiens
MILTDSRIA

SEQ ID NO: 3236 - protein, 9 aa, Homo Sapiens
IAQIGVASV

SEQ ID NO: 3237 - protein, 9 aa, Homo Sapiens
IRGLLMLTP

SEQ ID NO: 3238 - protein, 9 aa, Homo Sapiens
MKLSCTDTR

SEQ ID NO: 3239 - protein, 9 aa, Homo Sapiens
RTVLSVASP

SEQ ID NO: 3240 - protein, 9 aa, Homo Sapiens
VLSVASPEE

SEQ ID NO: 3241 - protein, 9 aa, Homo Sapiens
ETFSTCVSH

SEQ ID NO: 3242 - protein, 9 aa, Homo Sapiens
ATDLGLSIS

SEQ ID NO: 3243 - protein, 9 aa, Homo Sapiens
AMAFDRFVA

SEQ ID NO: 3244 - protein, 9 aa, Homo Sapiens
NPLRYAMIL

SEQ ID NO: 3245 - protein, 9 aa, Homo Sapiens
SYCHSQVLH

SEQ ID NO: 3246 - protein, 9 aa, Homo Sapiens
ERKETFSTC

SEQ ID NO: 3247 - protein, 9 aa, Homo Sapiens
TCVSHIVAF

SEQ ID NO: 3248 - protein, 9 aa, Homo Sapiens
IYYIPLISL

SEQ ID NO: 3249 - protein, 9 aa, Homo Sapiens
YYIPLISLS

SEQ ID NO: 3250 - protein, 9 aa, Homo Sapiens
RRAVIKILH

SEQ ID NO: 3251 - protein, 9 aa, Homo Sapiens
RAVIKILHS

SEQ ID NO: 3252 - protein, 9 aa, Homo Sapiens
STLVTMLSI

SEQ ID NO: 3253 - protein, 9 aa, Homo Sapiens
WFNVREISF

SEQ ID NO: 3254 - protein, 9 aa, Homo Sapiens
FFIKFFTVM

SEQ ID NO: 3255 - protein, 9 aa, Homo Sapiens
MAFDRFVAV

SEQ ID NO: 3256 - protein, 9 aa, Homo Sapiens
SNPLRYAMI

SEQ ID NO: 3257 - protein, 9 aa, Homo Sapiens
LTDSRIAQI

SEQ ID NO: 3258 - protein, 9 aa, Homo Sapiens
RGLLMLTPM

SEQ ID NO: 3259 - protein, 9 aa, Homo Sapiens
LSYCHSQVL

SEQ ID NO: 3260 - protein, 9 aa, Homo Sapiens
HSQVLHHSY

SEQ ID NO: 3261 - protein, 9 aa, Homo Sapiens
AMFSTVGVD

SEQ ID NO: 3262 - protein, 9 aa, Homo Sapiens
MFSTVGVDL

SEQ ID NO: 3263 - protein, 9 aa, Homo Sapiens
IPLISLSIV

SEQ ID NO: 3264 - protein, 9 aa, Homo Sapiens
ISLSIVHRF

SEQ ID NO: 3265 - protein, 9 aa, Homo Sapiens
QAPAYVHTM

SEQ ID NO: 3266 - protein, 9 aa, Homo Sapiens
NTYLLISPL

SEQ ID NO: 3267 - protein, 9 aa, Homo Sapiens
IRRAVIKIL

SEQ ID NO: 3268 - protein, 9 aa, Homo Sapiens
FTVMESSVL

SEQ ID NO: 3269 - protein, 9 aa, Homo Sapiens
RFVAVSNPL

SEQ ID NO: 3270 - protein, 9 aa, Homo Sapiens
YAMILTDSR

SEQ ID NO: 3271 - protein, 9 aa, Homo Sapiens
LMLTPMVAL

SEQ ID NO: 3272 - protein, 9 aa, Homo Sapiens
LTPMVALLI

SEQ ID NO: 3273 - protein, 9 aa, Homo Sapiens
TPMVALLIR

SEQ ID NO: 3274 - protein, 9 aa, Homo Sapiens
YCHSQVLHH

SEQ ID NO: 3275 - protein, 9 aa, Homo Sapiens
TDTRINSAV

SEQ ID NO: 3276 - protein, 9 aa, Homo Sapiens
STVGVDLLL

SEQ ID NO: 3277 - protein, 9 aa, Homo Sapiens
IRTVLSVAS

SEQ ID NO: 3278 - protein, 9 aa, Homo Sapiens
LSVASPEER

SEQ ID NO: 3279 - protein, 9 aa, Homo Sapiens
KETFSTCVS

SEQ ID NO: 3280 - protein, 9 aa, Homo Sapiens
APAYVHTMI

SEQ ID NO: 3281 - protein, 9 aa, Homo Sapiens
ISPLMNPVI

SEQ ID NO: 3282 - protein, 9 aa, Homo Sapiens
YYFLSMLSA

SEQ ID NO: 3283 - protein, 9 aa, Homo Sapiens
YFLSMLSAT

SEQ ID NO: 3284 - protein, 9 aa, Homo Sapiens
TDLGLSIST

SEQ ID NO: 3285 - protein, 9 aa, Homo Sapiens
VTMLSIFWF

SEQ ID NO: 3286 - protein, 9 aa, Homo Sapiens
FNVREISFN

SEQ ID NO: 3287 - protein, 9 aa, Homo Sapiens
SFNACLSHM

SEQ ID NO: 3288 - protein, 9 aa, Homo Sapiens
FNACLSHMF

SEQ ID NO: 3289 - protein, 9 aa, Homo Sapiens
NACLSHMFF

SEQ ID NO: 3290 - protein, 9 aa, Homo Sapiens
MFFIKFFTV

SEQ ID NO: 3291 - protein, 9 aa, Homo Sapiens
KFFTVMESS

SEQ ID NO: 3292 - protein, 9 aa, Homo Sapiens
RYAMILTDS

SEQ ID NO: 3293 - protein, 9 aa, Homo Sapiens
TDSRIAQIG

SEQ ID NO: 3294 - protein, 9 aa, Homo Sapiens
IRLSYCHSQ

SEQ ID NO: 3295 - protein, 9 aa, Homo Sapiens
SYCYHPDVM

SEQ ID NO: 3296 - protein, 9 aa, Homo Sapiens
LTAMFSTVG

SEQ ID NO: 3297 - protein, 9 aa, Homo Sapiens
VDLLLILLS

SEQ ID NO: 3298 - protein, 9 aa, Homo Sapiens
SYVLIIRTV

SEQ ID NO: 3299 - protein, 9 aa, Homo Sapiens
VSHIVAFAI

SEQ ID NO: 3300 - protein, 9 aa, Homo Sapiens
VHRFGKQAP

SEQ ID NO: 3301 - protein, 9 aa, Homo Sapiens
HRFGKQAPA

SEQ ID NO: 3302 - protein, 9 aa, Homo Sapiens
LMNPVIYSV

SEQ ID NO: 3303 - protein, 9 aa, Homo Sapiens
IYSVKTKQI

SEQ ID NO: 3304 - protein, 9 aa, Homo Sapiens
KTKQIRRAV

SEQ ID NO: 3305 - protein, 9 aa, Homo Sapiens
IKILHSKET

SEQ ID NO: 3306 - protein, 9 aa, Homo Sapiens
MYYFLSMLS

SEQ ID NO: 3307 - protein, 9 aa, Homo Sapiens
LSMLSATDL

SEQ ID NO: 3308 - protein, 9 aa, Homo Sapiens
ISTLVTMLS

SEQ ID NO: 3309 - protein, 9 aa, Homo Sapiens
ACLSHMFFI

SEQ ID NO: 3310 - protein, 9 aa, Homo Sapiens
SHMFFIKFF

SEQ ID NO: 3311 - protein, 9 aa, Homo Sapiens
FFTVMESSV

SEQ ID NO: 3312 - protein, 9 aa, Homo Sapiens
MESSVLLAM

SEQ ID NO: 3313 - protein, 9 aa, Homo Sapiens
VSNPLRYAM

SEQ ID NO: 3314 - protein, 9 aa, Homo Sapiens
SQVLHHSYC

SEQ ID NO: 3315 - protein, 9 aa, Homo Sapiens
HPDVMKLSC

SEQ ID NO: 3316 - protein, 9 aa, Homo Sapiens
NSAVGLTAM

SEQ ID NO: 3317 - protein, 9 aa, Homo Sapiens
ASPEERKET

SEQ ID NO: 3318 - protein, 9 aa, Homo Sapiens
PEERKETFS

SEQ ID NO: 3319 - protein, 9 aa, Homo Sapiens
EERKETFST

SEQ ID NO: 3320 - protein, 9 aa, Homo Sapiens
RKETFSTCV

SEQ ID NO: 3321 - protein, 9 aa, Homo Sapiens
STCVSHIVA

SEQ ID NO: 3322 - protein, 9 aa, Homo Sapiens
AFAIYYIPL

SEQ ID NO: 3323 - protein, 9 aa, Homo Sapiens
FGKQAPAYV

SEQ ID NO: 3324 - protein, 9 aa, Homo Sapiens
PAYVHTMIA

SEQ ID NO: 3325 - protein, 9 aa, Homo Sapiens
TMIANTYLL

SEQ ID NO: 3326 - protein, 9 aa, Homo Sapiens
IANTYLLIS

SEQ ID NO: 3327 - protein, 9 aa, Homo Sapiens
ANTYLLISP

SEQ ID NO: 3328 - protein, 9 aa, Homo Sapiens
NPVIYSVKT

SEQ ID NO: 3329 - protein, 9 aa, Homo Sapiens
LSHMFFIKF

SEQ ID NO: 3330 - protein, 9 aa, Homo Sapiens
ESSVLLAMA

SEQ ID NO: 3331 - protein, 9 aa, Homo Sapiens
DSRIAQIGV

SEQ ID NO: 3332 - protein, 9 aa, Homo Sapiens
IGVASVIRG

SEQ ID NO: 3333 - protein, 9 aa, Homo Sapiens
HSYCYHPDV

SEQ ID NO: 3334 - protein, 9 aa, Homo Sapiens
CYHPDVMKL

SEQ ID NO: 3335 - protein, 9 aa, Homo Sapiens
PDVMKLSCT

SEQ ID NO: 3336 - protein, 9 aa, Homo Sapiens
CTDTRINSA

SEQ ID NO: 3337 - protein, 9 aa, Homo Sapiens
VGLTAMFST

SEQ ID NO: 3338 - protein, 9 aa, Homo Sapiens
TAMFSTVGV

SEQ ID NO: 3339 - protein, 9 aa, Homo Sapiens
VGVDLLLIL

SEQ ID NO: 3340 - protein, 9 aa, Homo Sapiens
LSYVLIIRT

SEQ ID NO: 3341 - protein, 9 aa, Homo Sapiens
AYVHTMIAN

SEQ ID NO: 3342 - protein, 9 aa, Homo Sapiens
YSVKTKQIR

SEQ ID NO: 3343 - protein, 9 aa, Homo Sapiens
SMLSATDLG

SEQ ID NO: 3344 - protein, 9 aa, Homo Sapiens
LGLSISTLV

SEQ ID NO: 3345 - protein, 9 aa, Homo Sapiens
FWFNVREIS

SEQ ID NO: 3346 - protein, 9 aa, Homo Sapiens
IKFFTVMES

SEQ ID NO: 3347 - protein, 9 aa, Homo Sapiens
VMESSVLLA

SEQ ID NO: 3348 - protein, 9 aa, Homo Sapiens
DRFVAVSNP

SEQ ID NO: 3349 - protein, 9 aa, Homo Sapiens
VMKLSCTDT

SEQ ID NO: 3350 - protein, 9 aa, Homo Sapiens
SCTDTRINS

SEQ ID NO: 3351 - protein, 9 aa, Homo Sapiens
VASPEERKE

SEQ ID NO: 3352 - protein, 9 aa, Homo Sapiens
TFSTCVSHI

SEQ ID NO: 3353 - protein, 9 aa, Homo Sapiens
FAIYYIPLI

SEQ ID NO: 3354 - protein, 9 aa, Homo Sapiens
TYLLISPLM

SEQ ID NO: 3355 - protein, 9 aa, Homo Sapiens
LSATDLGLS

SEQ ID NO: 3356 - protein, 9 aa, Homo Sapiens
TMLSIFWFN

SEQ ID NO: 3357 - protein, 9 aa, Homo Sapiens
IFWFNVREI

SEQ ID NO: 3358 - protein, 9 aa, Homo Sapiens
VREISFNAC

SEQ ID NO: 3359 - protein, 9 aa, Homo Sapiens
LAMAFDRFV

SEQ ID NO: 3360 - protein, 9 aa, Homo Sapiens
VASVIRGLL

SEQ ID NO: 3361 - protein, 9 aa, Homo Sapiens
PMVALLIRL

SEQ ID NO: 3362 - protein, 9 aa, Homo Sapiens
YHPDVMKLS

SEQ ID NO: 3363 - protein, 9 aa, Homo Sapiens
FSTVGVDLL

SEQ ID NO: 3364 - protein, 9 aa, Homo Sapiens
VAFAIYYIP

SEQ ID NO: 3365 - protein, 9 aa, Homo Sapiens
HTMIANTYL

SEQ ID NO: 3366 - protein, 9 aa, Homo Sapiens
CHSQVLHHS

SEQ ID NO: 3367 - protein, 9 aa, Homo Sapiens
FSTCVSHIV

SEQ ID NO: 3368 - protein, 9 aa, Homo Sapiens
NPLRYAMIL

SEQ ID NO: 3369 - protein, 9 aa, Homo Sapiens
APAYVHTMI

SEQ ID NO: 3370 - protein, 9 aa, Homo Sapiens
NPVIYSVKT

SEQ ID NO: 3371 - protein, 9 aa, Homo Sapiens
IPLISLSIV

SEQ ID NO: 3372 - protein, 9 aa, Homo Sapiens
LMLTPMVAL

SEQ ID NO: 3373 - protein, 9 aa, Homo Sapiens
SPEERKETF

SEQ ID NO: 3374 - protein, 9 aa, Homo Sapiens
MLSATDLGL

SEQ ID NO: 3375 - protein, 9 aa, Homo Sapiens
MFSTVGVDL

SEQ ID NO: 3376 - protein, 9 aa, Homo Sapiens
SISTLVTML

SEQ ID NO: 3377 - protein, 9 aa, Homo Sapiens
STVGVDLLL

SEQ ID NO: 3378 - protein, 9 aa, Homo Sapiens
AFAIYYIPL

SEQ ID NO: 3379 - protein, 9 aa, Homo Sapiens
IYYIPLISL

SEQ ID NO: 3380 - protein, 9 aa, Homo Sapiens
IRRAVIKIL

SEQ ID NO: 3381 - protein, 9 aa, Homo Sapiens
TVMESSVLL

SEQ ID NO: 3382 - protein, 9 aa, Homo Sapiens
RFVAVSNPL

SEQ ID NO: 3383 - protein, 9 aa, Homo Sapiens
AVSNPLRYA

SEQ ID NO: 3384 - protein, 9 aa, Homo Sapiens
VASVIRGLL

SEQ ID NO: 3385 - protein, 9 aa, Homo Sapiens
MLTPMVALL

SEQ ID NO: 3386 - protein, 9 aa, Homo Sapiens
TPMVALLIR

SEQ ID NO: 3387 - protein, 9 aa, Homo Sapiens
HPDVMKLSC

SEQ ID NO: 3388 - protein, 9 aa, Homo Sapiens
INSAVGLTA

SEQ ID NO: 3389 - protein, 9 aa, Homo Sapiens
YVLIIRTVL

SEQ ID NO: 3390 - protein, 9 aa, Homo Sapiens
LSMLSATDL

SEQ ID NO: 3391 - protein, 9 aa, Homo Sapiens
GLSISTLVT

SEQ ID NO: 3392 - protein, 9 aa, Homo Sapiens
REISFNACL

SEQ ID NO: 3393 - protein, 9 aa, Homo Sapiens
SVIRGLLML

SEQ ID NO: 3394 - protein, 9 aa, Homo Sapiens
CYHPDVMKL

SEQ ID NO: 3395 - protein, 9 aa, Homo Sapiens
TRINSAVGL

SEQ ID NO: 3396 - protein, 9 aa, Homo Sapiens
VGVDLLLIL

SEQ ID NO: 3397 - protein, 9 aa, Homo Sapiens
HTMIANTYL

SEQ ID NO: 3398 - protein, 9 aa, Homo Sapiens
TMIANTYLL

SEQ ID NO: 3399 - protein, 9 aa, Homo Sapiens
SPLMNPVIY

SEQ ID NO: 3400 - protein, 9 aa, Homo Sapiens
DLGLSISTL

SEQ ID NO: 3401 - protein, 9 aa, Homo Sapiens
FTVMESSVL

SEQ ID NO: 3402 - protein, 9 aa, Homo Sapiens
MESSVLLAM

SEQ ID NO: 3403 - protein, 9 aa, Homo Sapiens
AMAFDRFVA

SEQ ID NO: 3404 - protein, 9 aa, Homo Sapiens
AQIGVASVI

SEQ ID NO: 3405 - protein, 9 aa, Homo Sapiens
GVASVIRGL

SEQ ID NO: 3406 - protein, 9 aa, Homo Sapiens
ASVIRGLLM

SEQ ID NO: 3407 - protein, 9 aa, Homo Sapiens
PMVALLIRL

SEQ ID NO: 3408 - protein, 9 aa, Homo Sapiens
LSYCHSQVL

SEQ ID NO: 3409 - protein, 9 aa, Homo Sapiens
FSTVGVDLL

SEQ ID NO: 3410 - protein, 9 aa, Homo Sapiens
GVDLLLILL

SEQ ID NO: 3411 - protein, 9 aa, Homo Sapiens
LLILLSYVL

SEQ ID NO: 3412 - protein, 9 aa, Homo Sapiens
EERKETFST

SEQ ID NO: 3413 - protein, 9 aa, Homo Sapiens
CVSHIVAFA

SEQ ID NO: 3414 - protein, 9 aa, Homo Sapiens
KQAPAYVHT

SEQ ID NO: 3415 - protein, 9 aa, Homo Sapiens
NTYLLISPL

SEQ ID NO: 3416 - protein, 9 aa, Homo Sapiens
FFIKFFTVM

SEQ ID NO: 3417 - protein, 9 aa, Homo Sapiens
ESSVLLAMA

SEQ ID NO: 3418 - protein, 9 aa, Homo Sapiens
MAFDRFVAV

SEQ ID NO: 3419 - protein, 9 aa, Homo Sapiens
VIRGLLMLT

SEQ ID NO: 3420 - protein, 9 aa, Homo Sapiens
KLSCTDTRI

SEQ ID NO: 3421 - protein, 9 aa, Homo Sapiens
SAVGLTAMF

SEQ ID NO: 3422 - protein, 9 aa, Homo Sapiens
TAMFSTVGV

SEQ ID NO: 3423 - protein, 9 aa, Homo Sapiens
ILLSYVLII

SEQ ID NO: 3424 - protein, 9 aa, Homo Sapiens
IIRTVLSVA

SEQ ID NO: 3425 - protein, 9 aa, Homo Sapiens
HRFGKQAPA

SEQ ID NO: 3426 - protein, 9 aa, Homo Sapiens
LISPLMNPV

SEQ ID NO: 3427 - protein, 9 aa, Homo Sapiens
IYSVKTKQI

SEQ ID NO: 3428 - protein, 9 aa, Homo Sapiens
SATDLGLSI

SEQ ID NO: 3429 - protein, 9 aa, Homo Sapiens
ACLSHMFFI

SEQ ID NO: 3430 - protein, 9 aa, Homo Sapiens
VMESSVLLA

SEQ ID NO: 3431 - protein, 9 aa, Homo Sapiens
LAMAFDRFV

SEQ ID NO: 3432 - protein, 9 aa, Homo Sapiens
VSNPLRYAM

SEQ ID NO: 3433 - protein, 9 aa, Homo Sapiens
IAQIGVASV

SEQ ID NO: 3434 - protein, 9 aa, Homo Sapiens
RGLLMLTPM

SEQ ID NO: 3435 - protein, 9 aa, Homo Sapiens
RLSYCHSQV

SEQ ID NO: 3436 - protein, 9 aa, Homo Sapiens
NSAVGLTAM

SEQ ID NO: 3437 - protein, 9 aa, Homo Sapiens
TVGVDLLLI

SEQ ID NO: 3438 - protein, 9 aa, Homo Sapiens
LIIRTVLSV

SEQ ID NO: 3439 - protein, 9 aa, Homo Sapiens
ASPEERKET

SEQ ID NO: 3440 - protein, 9 aa, Homo Sapiens
TFSTCVSHI

SEQ ID NO: 3441 - protein, 9 aa, Homo Sapiens
TCVSHIVAF

SEQ ID NO: 3442 - protein, 9 aa, Homo Sapiens
MIANTYLLI

SEQ ID NO: 3443 - protein, 9 aa, Homo Sapiens
ISPLMNPVI

SEQ ID NO: 3444 - protein, 9 aa, Homo Sapiens
KTKQIRRAV

SEQ ID NO: 3445 - protein, 9 aa, Homo Sapiens
TKQIRRAVI

SEQ ID NO: 3446 - protein, 9 aa, Homo Sapiens
QIRRAVIKI

SEQ ID NO: 3447 - protein, 9 aa, Homo Sapiens
YYFLSMLSA

SEQ ID NO: 3448 - protein, 9 aa, Homo Sapiens
TDLGLSIST

SEQ ID NO: 3449 - protein, 9 aa, Homo Sapiens
LSISTLVTM

SEQ ID NO: 3450 - protein, 9 aa, Homo Sapiens
STLVTMLSI

SEQ ID NO: 3451 - protein, 9 aa, Homo Sapiens
MLSIFWFNV

SEQ ID NO: 3452 - protein, 9 aa, Homo Sapiens
IFWFNVREI

SEQ ID NO: 3453 - protein, 9 aa, Homo Sapiens
NVREISFNA

SEQ ID NO: 3454 - protein, 9 aa, Homo Sapiens
SHMFFIKFF

SEQ ID NO: 3455 - protein, 9 aa, Homo Sapiens
LLAMAFDRF

SEQ ID NO: 3456 - protein, 9 aa, Homo Sapiens
PLRYAMILT

SEQ ID NO: 3457 - protein, 9 aa, Homo Sapiens
AMILTDSRI

SEQ ID NO: 3458 - protein, 9 aa, Homo Sapiens
LTDSRIAQI

SEQ ID NO: 3459 - protein, 9 aa, Homo Sapiens
DSRIAQIGV

SEQ ID NO: 3460 - protein, 9 aa, Homo Sapiens
SRIAQIGVA

SEQ ID NO: 3461 - protein, 9 aa, Homo Sapiens
GLLMLTPMV

SEQ ID NO: 3462 - protein, 9 aa, Homo Sapiens
LLMLTPMVA

SEQ ID NO: 3463 - protein, 9 aa, Homo Sapiens
LTPMVALLI

SEQ ID NO: 3464 - protein, 9 aa, Homo Sapiens
RINSAVGLT

SEQ ID NO: 3465 - protein, 9 aa, Homo Sapiens
GLTAMFSTV

SEQ ID NO: 3466 - protein, 9 aa, Homo Sapiens
LILLSYVLI

SEQ ID NO: 3467 - protein, 9 aa, Homo Sapiens
RKETFSTCV

SEQ ID NO: 3468 - protein, 9 aa, Homo Sapiens
IVAFAIYYI

SEQ ID NO: 3469 - protein, 9 aa, Homo Sapiens
YIPLISLSI

SEQ ID NO: 3470 - protein, 9 aa, Homo Sapiens
ISLSIVHRF

SEQ ID NO: 3471 - protein, 9 aa, Homo Sapiens
IVHRFGKQA

SEQ ID NO: 3472 - protein, 9 aa, Homo Sapiens
QAPAYVHTM

SEQ ID NO: 3473 - protein, 9 aa, Homo Sapiens
YFLSMLSAT

SEQ ID NO: 3474 - protein, 9 aa, Homo Sapiens
LGLSISTLV

SEQ ID NO: 3475 - protein, 9 aa, Homo Sapiens
VTMLSIFWF

SEQ ID NO: 3476 - protein, 9 aa, Homo Sapiens
SFNACLSHM

SEQ ID NO: 3477 - protein, 9 aa, Homo Sapiens
FNACLSHMF

SEQ ID NO: 3478 - protein, 9 aa, Homo Sapiens
NACLSHMFF

SEQ ID NO: 3479 - protein, 9 aa, Homo Sapiens
LSHMFFIKF

SEQ ID NO: 3480 - protein, 9 aa, Homo Sapiens
HMFFIKFFT

SEQ ID NO: 3481 - protein, 9 aa, Homo Sapiens
MFFIKFFTV

SEQ ID NO: 3482 - protein, 9 aa, Homo Sapiens
SSVLLAMAF

SEQ ID NO: 3483 - protein, 9 aa, Homo Sapiens
SNPLRYAMI

SEQ ID NO: 3484 - protein, 9 aa, Homo Sapiens
HSYCYHPDV

SEQ ID NO: 3485 - protein, 9 aa, Homo Sapiens
SYCYHPDVM

SEQ ID NO: 3486 - protein, 9 aa, Homo Sapiens
VMKLSCTDT

SEQ ID NO: 3487 - protein, 9 aa, Homo Sapiens
CTDTRINSA

SEQ ID NO: 3488 - protein, 9 aa, Homo Sapiens
TDTRINSAV

SEQ ID NO: 3489 - protein, 9 aa, Homo Sapiens
STCVSHIVA

SEQ ID NO: 3490 - protein, 9 aa, Homo Sapiens
VSHIVAFAI

SEQ ID NO: 3491 - protein, 9 aa, Homo Sapiens
FAIYYIPLI

SEQ ID NO: 3492 - protein, 9 aa, Homo Sapiens
FGKQAPAYV

SEQ ID NO: 3493 - protein, 9 aa, Homo Sapiens
PAYVHTMIA

SEQ ID NO: 3494 - protein, 9 aa, Homo Sapiens
YVHTMIANT

SEQ ID NO: 3495 - protein, 9 aa, Homo Sapiens
TYLLISPLM

SEQ ID NO: 3496 - protein, 9 aa, Homo Sapiens
LMNPVIYSV

SEQ ID NO: 3497 - protein, 9 aa, Homo Sapiens
VKTKQIRRA

SEQ ID NO: 3498 - protein, 9 aa, Homo Sapiens
IKILHSKET

SEQ ID NO: 3499 - protein, 9 aa, Homo Sapiens
TLVTMLSIF

SEQ ID NO: 3500 - protein, 9 aa, Homo Sapiens
WFNVREISF

SEQ ID NO: 3501 - protein, 9 aa, Homo Sapiens
FFTVMESSV

SEQ ID NO: 3502 - protein, 9 aa, Homo Sapiens
AFDRFVAVS

SEQ ID NO: 3503 - protein, 9 aa, Homo Sapiens
MILTDSRIA

SEQ ID NO: 3504 - protein, 9 aa, Homo Sapiens
RIAQIGVAS

SEQ ID NO: 3505 - protein, 9 aa, Homo Sapiens
PDVMKLSCT

SEQ ID NO: 3506 - protein, 9 aa, Homo Sapiens
VGLTAMFST

SEQ ID NO: 3507 - protein, 9 aa, Homo Sapiens
LLLILLSYV

SEQ ID NO: 3508 - protein, 9 aa, Homo Sapiens
LSYVLIIRT

SEQ ID NO: 3509 - protein, 9 aa, Homo Sapiens
SYVLIIRTV

SEQ ID NO: 3510 - protein, 9 aa, Homo Sapiens
FSTCVSHIV

SEQ ID NO: 3511 - protein, 9 aa, Homo Sapiens
YCYHPDVMK

SEQ ID NO: 3512 - protein, 9 aa, Homo Sapiens
RFGKQAPAY

SEQ ID NO: 3513 - protein, 9 aa, Homo Sapiens
GKQAPAYVH

SEQ ID NO: 3514 - protein, 9 aa, Homo Sapiens
PLMNPVIYS

SEQ ID NO: 3515 - protein, 9 aa, Homo Sapiens
FDRFVAVSN

SEQ ID NO: 3516 - protein, 9 aa, Homo Sapiens
IRGLLMLTP

SEQ ID NO: 3517 - protein, 9 aa, Homo Sapiens
DTRINSAVG

SEQ ID NO: 3518 - protein, 9 aa, Homo Sapiens
AVGLTAMFS

SEQ ID NO: 3519 - protein, 9 aa, Homo Sapiens
AMFSTVGVD

SEQ ID NO: 3520 - protein, 9 aa, Homo Sapiens
IRTVLSVAS

SEQ ID NO: 3521 - protein, 9 aa, Homo Sapiens
SVASPEERK

SEQ ID NO: 3522 - protein, 9 aa, Homo Sapiens
AIYYIPLIS

SEQ ID NO: 3523 - protein, 9 aa, Homo Sapiens
LISLSIVHR

SEQ ID NO: 3524 - protein, 9 aa, Homo Sapiens
FLSMLSATD

SEQ ID NO: 3525 - protein, 9 aa, Homo Sapiens
ATDLGLSIS

SEQ ID NO: 3526 - protein, 9 aa, Homo Sapiens
EISFNACLS

SEQ ID NO: 3527 - protein, 9 aa, Homo Sapiens
ISFNACLSH

SEQ ID NO: 3528 - protein, 9 aa, Homo Sapiens
CLSHMFFIK

SEQ ID NO: 3529 - protein, 9 aa, Homo Sapiens
FIKFFTVME

SEQ ID NO: 3530 - protein, 9 aa, Homo Sapiens
LRYAMILTD

SEQ ID NO: 3531 - protein, 9 aa, Homo Sapiens
RYAMILTDS

SEQ ID NO: 3532 - protein, 9 aa, Homo Sapiens
ILTDSRIAQ

SEQ ID NO: 3533 - protein, 9 aa, Homo Sapiens
QIGVASVIR

SEQ ID NO: 3534 - protein, 9 aa, Homo Sapiens
IGVASVIRG

SEQ ID NO: 3535 - protein, 9 aa, Homo Sapiens
VALLIRLSY

SEQ ID NO: 3536 - protein, 9 aa, Homo Sapiens
YCHSQVLHH

SEQ ID NO: 3537 - protein, 9 aa, Homo Sapiens
HHSYCYHPD

SEQ ID NO: 3538 - protein, 9 aa, Homo Sapiens
LTAMFSTVG

SEQ ID NO: 3539 - protein, 9 aa, Homo Sapiens
VLIIRTVLS

SEQ ID NO: 3540 - protein, 9 aa, Homo Sapiens
RTVLSVASP

SEQ ID NO: 3541 - protein, 9 aa, Homo Sapiens
VLSVASPEE

SEQ ID NO: 3542 - protein, 9 aa, Homo Sapiens
VASPEERKE

SEQ ID NO: 3543 - protein, 9 aa, Homo Sapiens
KETFSTCVS

SEQ ID NO: 3544 - protein, 9 aa, Homo Sapiens
ETFSTCVSH

SEQ ID NO: 3545 - protein, 9 aa, Homo Sapiens
SLSIVHRFG

SEQ ID NO: 3546 - protein, 9 aa, Homo Sapiens
VHRFGKQAP

SEQ ID NO: 3547 - protein, 9 aa, Homo Sapiens
AYVHTMIAN

SEQ ID NO: 3548 - protein, 9 aa, Homo Sapiens
IANTYLLIS

SEQ ID NO: 3549 - protein, 9 aa, Homo Sapiens
LLISPLMNP

SEQ ID NO: 3550 - protein, 9 aa, Homo Sapiens
KQIRRAVIK

SEQ ID NO: 3551 - protein, 9 aa, Homo Sapiens
RAVIKILHS

SEQ ID NO: 3552 - protein, 9 aa, Homo Sapiens
AVIKILHSK

SEQ ID NO: 3553 - protein, 9 aa, Homo Sapiens
ISTLVTMLS

SEQ ID NO: 3554 - protein, 9 aa, Homo Sapiens
TMLSIFWFN

SEQ ID NO: 3555 - protein, 9 aa, Homo Sapiens
LSIFWFNVR

SEQ ID NO: 3556 - protein, 9 aa, Homo Sapiens
SIFWFNVRE

SEQ ID NO: 3557 - protein, 9 aa, Homo Sapiens
VREISFNAC

SEQ ID NO: 3558 - protein, 9 aa, Homo Sapiens
IKFFTVMES

SEQ ID NO: 3559 - protein, 9 aa, Homo Sapiens
SVLLAMAFD

SEQ ID NO: 3560 - protein, 9 aa, Homo Sapiens
FVAVSNPLR

SEQ ID NO: 3561 - protein, 9 aa, Homo Sapiens
VAVSNPLRY

SEQ ID NO: 3562 - protein, 9 aa, Homo Sapiens
YAMILTDSR

SEQ ID NO: 3563 - protein, 9 aa, Homo Sapiens
TDSRIAQIG

SEQ ID NO: 3564 - protein, 9 aa, Homo Sapiens
ALLIRLSYC

SEQ ID NO: 3565 - protein, 9 aa, Homo Sapiens
LIRLSYCHS

SEQ ID NO: 3566 - protein, 9 aa, Homo Sapiens
SYCHSQVLH

SEQ ID NO: 3567 - protein, 9 aa, Homo Sapiens
CHSQVLHHS

SEQ ID NO: 3568 - protein, 9 aa, Homo Sapiens
DVMKLSCTD

SEQ ID NO: 3569 - protein, 9 aa, Homo Sapiens
VDLLLILLS

SEQ ID NO: 3570 - protein, 9 aa, Homo Sapiens
DLLLILLSY

SEQ ID NO: 3571 - protein, 9 aa, Homo Sapiens
LLSYVLIIR

SEQ ID NO: 3572 - protein, 9 aa, Homo Sapiens
PEERKETFS

SEQ ID NO: 3573 - protein, 9 aa, Homo Sapiens
ERKETFSTC

SEQ ID NO: 3574 - protein, 9 aa, Homo Sapiens
SHIVAFAIY

SEQ ID NO: 3575 - protein, 9 aa, Homo Sapiens
ANTYLLISP

SEQ ID NO: 3576 - protein, 9 aa, Homo Sapiens
YLLISPLMN

SEQ ID NO: 3577 - protein, 9 aa, Homo Sapiens
RRAVIKILH

SEQ ID NO: 3578 - protein, 9 aa, Homo Sapiens
SMLSATDLG

SEQ ID NO: 3579 - protein, 9 aa, Homo Sapiens
LSATDLGLS

SEQ ID NO: 3580 - protein, 9 aa, Homo Sapiens
LVTMLSIFW

SEQ ID NO: 3581 - protein, 9 aa, Homo Sapiens
FWFNVREIS

SEQ ID NO: 3582 - protein, 9 aa, Homo Sapiens
FNVREISFN

SEQ ID NO: 3583 - protein, 9 aa, Homo Sapiens
KFFTVMESS

SEQ ID NO: 3584 - protein, 9 aa, Homo Sapiens
VLLAMAFDR

SEQ ID NO: 3585 - protein, 9 aa, Homo Sapiens
DRFVAVSNP

SEQ ID NO: 3586 - protein, 9 aa, Homo Sapiens
MVALLIRLS

SEQ ID NO: 3587 - protein, 9 aa, Homo Sapiens
IRLSYCHSQ

SEQ ID NO: 3588 - protein, 9 aa, Homo Sapiens
MKLSCTDTR

SEQ ID NO: 3589 - protein, 9 aa, Homo Sapiens
LSCTDTRIN

SEQ ID NO: 3590 - protein, 9 aa, Homo Sapiens
SCTDTRINS

SEQ ID NO: 3591 - protein, 9 aa, Homo Sapiens
TVLSVASPE

SEQ ID NO: 3592 - protein, 9 aa, Homo Sapiens
LSVASPEER

SEQ ID NO: 3593 - protein, 9 aa, Homo Sapiens
HIVAFAIYY

SEQ ID NO: 3594 - protein, 9 aa, Homo Sapiens
VAFAIYYIP

SEQ ID NO: 3595 - protein, 9 aa, Homo Sapiens
YYIPLISLS

SEQ ID NO: 3596 - protein, 9 aa, Homo Sapiens
PLISLSIVH

SEQ ID NO: 3597 - protein, 9 aa, Homo Sapiens
LSIVHRFGK

SEQ ID NO: 3598 - protein, 9 aa, Homo Sapiens
SIVHRFGKQ

SEQ ID NO: 3599 - protein, 9 aa, Homo Sapiens
MNPVIYSVK

SEQ ID NO: 3600 - protein, 9 aa, Homo Sapiens
PVIYSVKTK

SEQ ID NO: 3601 - protein, 9 aa, Homo Sapiens
VIYSVKTKQ

SEQ ID NO: 3602 - protein, 9 aa, Homo Sapiens
YSVKTKQIR

SEQ ID NO: 3603 - protein, 9 aa, Homo Sapiens
SPEERKETF

SEQ ID NO: 3604 - protein, 9 aa, Homo Sapiens
SVKTKQIRR

SEQ ID NO: 3605 - protein, 9 aa, Homo Sapiens
IYSVKTKQI

SEQ ID NO: 3606 - protein, 9 aa, Homo Sapiens
IRRAVIKIL

SEQ ID NO: 3607 - protein, 9 aa, Homo Sapiens
DLGLSISTL

SEQ ID NO: 3608 - protein, 9 aa, Homo Sapiens
SISTLVTML

SEQ ID NO: 3609 - protein, 9 aa, Homo Sapiens
SNPLRYAMI

SEQ ID NO: 3610 - protein, 9 aa, Homo Sapiens
MLTPMVALL

SEQ ID NO: 3611 - protein, 9 aa, Homo Sapiens
LLILLSYVL

SEQ ID NO: 3612 - protein, 9 aa, Homo Sapiens
QIRRAVIKI

SEQ ID NO: 3613 - protein, 9 aa, Homo Sapiens
MLSATDLGL

SEQ ID NO: 3614 - protein, 9 aa, Homo Sapiens
FIKFFTVME

SEQ ID NO: 3615 - protein, 9 aa, Homo Sapiens
NPLRYAMIL

SEQ ID NO: 3616 - protein, 9 aa, Homo Sapiens
VASVIRGLL

SEQ ID NO: 3617 - protein, 9 aa, Homo Sapiens
VLIIRTVLS

SEQ ID NO: 3618 - protein, 9 aa, Homo Sapiens
WFNVREISF

SEQ ID NO: 3619 - protein, 9 aa, Homo Sapiens
LTDSRIAQI

SEQ ID NO: 3620 - protein, 9 aa, Homo Sapiens
RAVIKILHS

SEQ ID NO: 3621 - protein, 9 aa, Homo Sapiens
VIKILHSKE

SEQ ID NO: 3622 - protein, 9 aa, Homo Sapiens
MAFDRFVAV

SEQ ID NO: 3623 - protein, 9 aa, Homo Sapiens
ALLIRLSYC

SEQ ID NO: 3624 - protein, 9 aa, Homo Sapiens
ILLSYVLII

SEQ ID NO: 3625 - protein, 9 aa, Homo Sapiens
ERKETFSTC

SEQ ID NO: 3626 - protein, 9 aa, Homo Sapiens
SIVHRFGKQ

SEQ ID NO: 3627 - protein, 9 aa, Homo Sapiens
TKQIRRAVI

SEQ ID NO: 3628 - protein, 9 aa, Homo Sapiens
TVMESSVLL

SEQ ID NO: 3629 - protein, 9 aa, Homo Sapiens
PLRYAMILT

SEQ ID NO: 3630 - protein, 9 aa, Homo Sapiens
FSTVGVDLL

SEQ ID NO: 3631 - protein, 9 aa, Homo Sapiens
FAIYYIPLI

SEQ ID NO: 3632 - protein, 9 aa, Homo Sapiens
APAYVHTMI

SEQ ID NO: 3633 - protein, 9 aa, Homo Sapiens
SATDLGLSI

SEQ ID NO: 3634 - protein, 9 aa, Homo Sapiens
TLVTMLSIF

SEQ ID NO: 3635 - protein, 9 aa, Homo Sapiens
LLAMAFDRF

SEQ ID NO: 3636 - protein, 9 aa, Homo Sapiens
GVASVIRGL

SEQ ID NO: 3637 - protein, 9 aa, Homo Sapiens
SVIRGLLML

SEQ ID NO: 3638 - protein, 9 aa, Homo Sapiens
LMLTPMVAL

SEQ ID NO: 3639 - protein, 9 aa, Homo Sapiens
VMKLSCTDT

SEQ ID NO: 3640 - protein, 9 aa, Homo Sapiens
KLSCTDTRI

SEQ ID NO: 3641 - protein, 9 aa, Homo Sapiens
SAVGLTAMF

SEQ ID NO: 3642 - protein, 9 aa, Homo Sapiens
STVGVDLLL

SEQ ID NO: 3643 - protein, 9 aa, Homo Sapiens
GVDLLLILL

SEQ ID NO: 3644 - protein, 9 aa, Homo Sapiens
LILLSYVLI

SEQ ID NO: 3645 - protein, 9 aa, Homo Sapiens
HTMIANTYL

SEQ ID NO: 3646 - protein, 9 aa, Homo Sapiens
NTYLLISPL

SEQ ID NO: 3647 - protein, 9 aa, Homo Sapiens
LSMLSATDL

SEQ ID NO: 3648 - protein, 9 aa, Homo Sapiens
REISFNACL

SEQ ID NO: 3649 - protein, 9 aa, Homo Sapiens
NACLSHMFF

SEQ ID NO: 3650 - protein, 9 aa, Homo Sapiens
FTVMESSVL

SEQ ID NO: 3651 - protein, 9 aa, Homo Sapiens
VIRGLLMLT

SEQ ID NO: 3652 - protein, 9 aa, Homo Sapiens
LIRLSYCHS

SEQ ID NO: 3653 - protein, 9 aa, Homo Sapiens
CYHPDVMKL

SEQ ID NO: 3654 - protein, 9 aa, Homo Sapiens
TRINSAVGL

SEQ ID NO: 3655 - protein, 9 aa, Homo Sapiens
MFSTVGVDL

SEQ ID NO: 3656 - protein, 9 aa, Homo Sapiens
VGVDLLLIL

SEQ ID NO: 3657 - protein, 9 aa, Homo Sapiens
IIRTVLSVA

SEQ ID NO: 3658 - protein, 9 aa, Homo Sapiens
IYYIPLISL

SEQ ID NO: 3659 - protein, 9 aa, Homo Sapiens
YIPLISLSI

SEQ ID NO: 3660 - protein, 9 aa, Homo Sapiens
HRFGKQAPA

SEQ ID NO: 3661 - protein, 9 aa, Homo Sapiens
FGKQAPAYV

SEQ ID NO: 3662 - protein, 9 aa, Homo Sapiens
KTKQIRRAV

SEQ ID NO: 3663 - protein, 9 aa, Homo Sapiens
SHMFFIKFF

SEQ ID NO: 3664 - protein, 9 aa, Homo Sapiens
MFFIKFFTV

SEQ ID NO: 3665 - protein, 9 aa, Homo Sapiens
SSVLLAMAF

SEQ ID NO: 3666 - protein, 9 aa, Homo Sapiens
RFVAVSNPL

SEQ ID NO: 3667 - protein, 9 aa, Homo Sapiens
PMVALLIRL

SEQ ID NO: 3668 - protein, 9 aa, Homo Sapiens
LSYCHSQVL

SEQ ID NO: 3669 - protein, 9 aa, Homo Sapiens
PDVMKLSCT

SEQ ID NO: 3670 - protein, 9 aa, Homo Sapiens
YVLIIRTVL

SEQ ID NO: 3671 - protein, 9 aa, Homo Sapiens
PEERKETFS

SEQ ID NO: 3672 - protein, 9 aa, Homo Sapiens
AFAIYYIPL

SEQ ID NO: 3673 - protein, 9 aa, Homo Sapiens
TMIANTYLL

SEQ ID NO: 3674 - protein, 9 aa, Homo Sapiens
MIANTYLLI

SEQ ID NO: 3675 - protein, 9 aa, Homo Sapiens
STLVTMLSI

SEQ ID NO: 3676 - protein, 9 aa, Homo Sapiens
VTMLSIFWF

SEQ ID NO: 3677 - protein, 9 aa, Homo Sapiens
IFWFNVREI

SEQ ID NO: 3678 - protein, 9 aa, Homo Sapiens
CTDTRINSA

SEQ ID NO: 3679 - protein, 9 aa, Homo Sapiens
VLSVASPEE

SEQ ID NO: 3680 - protein, 9 aa, Homo Sapiens
TCVSHIVAF

SEQ ID NO: 3681 - protein, 9 aa, Homo Sapiens
ISPLMNPVI

SEQ ID NO: 3682 - protein, 9 aa, Homo Sapiens
SPLMNPVIY

SEQ ID NO: 3683 - protein, 9 aa, Homo Sapiens
KQIRRAVIK

SEQ ID NO: 3684 - protein, 9 aa, Homo Sapiens
SIFWFNVRE

SEQ ID NO: 3685 - protein, 9 aa, Homo Sapiens
NVREISFNA

SEQ ID NO: 3686 - protein, 9 aa, Homo Sapiens
FDRFVAVSN

SEQ ID NO: 3687 - protein, 9 aa, Homo Sapiens
ILTDSRIAQ

SEQ ID NO: 3688 - protein, 9 aa, Homo Sapiens
ASVIRGLLM

SEQ ID NO: 3689 - protein, 9 aa, Homo Sapiens
HPDVMKLSC

SEQ ID NO: 3690 - protein, 9 aa, Homo Sapiens
EERKETFST

SEQ ID NO: 3691 - protein, 9 aa, Homo Sapiens
VSHIVAFAI

SEQ ID NO: 3692 - protein, 9 aa, Homo Sapiens
IVAFAIYYI

SEQ ID NO: 3693 - protein, 9 aa, Homo Sapiens
ISLSIVHRF

SEQ ID NO: 3694 - protein, 9 aa, Homo Sapiens
SLSIVHRFG

SEQ ID NO: 3695 - protein, 9 aa, Homo Sapiens
VHRFGKQAP

SEQ ID NO: 3696 - protein, 9 aa, Homo Sapiens
FLSMLSATD

SEQ ID NO: 3697 - protein, 9 aa, Homo Sapiens
GLSISTLVT

SEQ ID NO: 3698 - protein, 9 aa, Homo Sapiens
FNACLSHMF

SEQ ID NO: 3699 - protein, 9 aa, Homo Sapiens
VLLAMAFDR

SEQ ID NO: 3700 - protein, 9 aa, Homo Sapiens
AMILTDSRI

SEQ ID NO: 3701 - protein, 9 aa, Homo Sapiens
GLLMLTPMV

SEQ ID NO: 3702 - protein, 9 aa, Homo Sapiens
LLMLTPMVA

SEQ ID NO: 3703 - protein, 9 aa, Homo Sapiens
TPMVALLIR

SEQ ID NO: 3704 - protein, 9 aa, Homo Sapiens
RLSYCHSQV

SEQ ID NO: 3705 - protein, 9 aa, Homo Sapiens
VLHHSYCYH

SEQ ID NO: 3706 - protein, 9 aa, Homo Sapiens
GLTAMFSTV

SEQ ID NO: 3707 - protein, 9 aa, Homo Sapiens
TVGVDLLLI

SEQ ID NO: 3708 - protein, 9 aa, Homo Sapiens
DLLLILLSY

SEQ ID NO: 3709 - protein, 9 aa, Homo Sapiens
LLSYVLIIR

SEQ ID NO: 3710 - protein, 9 aa, Homo Sapiens
TFSTCVSHI

SEQ ID NO: 3711 - protein, 9 aa, Homo Sapiens
IPLISLSIV

SEQ ID NO: 3712 - protein, 9 aa, Homo Sapiens
LISLSIVHR

SEQ ID NO: 3713 - protein, 9 aa, Homo Sapiens
PLMNPVIYS

SEQ ID NO: 3714 - protein, 9 aa, Homo Sapiens
NPVIYSVKT

SEQ ID NO: 3715 - protein, 9 aa, Homo Sapiens
MLSIFWFNV

SEQ ID NO: 3716 - protein, 9 aa, Homo Sapiens
EISFNACLS

SEQ ID NO: 3717 - protein, 9 aa, Homo Sapiens
ACLSHMFFI

SEQ ID NO: 3718 - protein, 9 aa, Homo Sapiens
CLSHMFFIK

SEQ ID NO: 3719 - protein, 9 aa, Homo Sapiens
LSHMFFIKF

SEQ ID NO: 3720 - protein, 9 aa, Homo Sapiens
DSRIAQIGV

SEQ ID NO: 3721 - protein, 9 aa, Homo Sapiens
RIAQIGVAS

SEQ ID NO: 3722 - protein, 9 aa, Homo Sapiens
IAQIGVASV

SEQ ID NO: 3723 - protein, 9 aa, Homo Sapiens
AQIGVASVI

SEQ ID NO: 3724 - protein, 9 aa, Homo Sapiens
QIGVASVIR

SEQ ID NO: 3725 - protein, 9 aa, Homo Sapiens
LTPMVALLI

SEQ ID NO: 3726 - protein, 9 aa, Homo Sapiens
VALLIRLSY

SEQ ID NO: 3727 - protein, 9 aa, Homo Sapiens
LLIRLSYCH

SEQ ID NO: 3728 - protein, 9 aa, Homo Sapiens
DTRINSAVG

SEQ ID NO: 3729 - protein, 9 aa, Homo Sapiens
LLLILLSYV

SEQ ID NO: 3730 - protein, 9 aa, Homo Sapiens
PLISLSIVH

SEQ ID NO: 3731 - protein, 9 aa, Homo Sapiens
YLLISPLMN

SEQ ID NO: 3732 - protein, 9 aa, Homo Sapiens
LLISPLMNP

SEQ ID NO: 3733 - protein, 9 aa, Homo Sapiens
VAVSNPLRY

SEQ ID NO: 3734 - protein, 9 aa, Homo Sapiens
RINSAVGLT

SEQ ID NO: 3735 - protein, 9 aa, Homo Sapiens
TAMFSTVGV

SEQ ID NO: 3736 - protein, 9 aa, Homo Sapiens
LIIRTVLSV

SEQ ID NO: 3737 - protein, 9 aa, Homo Sapiens
VASPEERKE

SEQ ID NO: 3738 - protein, 9 aa, Homo Sapiens
HIVAFAIYY

SEQ ID NO: 3739 - protein, 9 aa, Homo Sapiens
VAFAIYYIP

SEQ ID NO: 3740 - protein, 9 aa, Homo Sapiens
AIYYIPLIS

SEQ ID NO: 3741 - protein, 9 aa, Homo Sapiens
QAPAYVHTM

SEQ ID NO: 3742 - protein, 9 aa, Homo Sapiens
PAYVHTMIA

SEQ ID NO: 3743 - protein, 9 aa, Homo Sapiens
IANTYLLIS

SEQ ID NO: 3744 - protein, 9 aa, Homo Sapiens
VIYSVKTKQ

SEQ ID NO: 3745 - protein, 9 aa, Homo Sapiens
LAMAFDRFV

SEQ ID NO: 3746 - protein, 9 aa, Homo Sapiens
YAMILTDSR

SEQ ID NO: 3747 - protein, 9 aa, Homo Sapiens
MILTDSRIA

SEQ ID NO: 3748 - protein, 9 aa, Homo Sapiens
SYVLIIRTV

SEQ ID NO: 3749 - protein, 9 aa, Homo Sapiens
IRTVLSVAS

SEQ ID NO: 3750 - protein, 9 aa, Homo Sapiens
ASPEERKET

SEQ ID NO: 3751 - protein, 9 aa, Homo Sapiens
LISPLMNPV

SEQ ID NO: 3752 - protein, 9 aa, Homo Sapiens
IKILHSKET

SEQ ID NO: 3753 - protein, 9 aa, Homo Sapiens
IKFFTVMES

SEQ ID NO: 3754 - protein, 9 aa, Homo Sapiens
ESSVLLAMA

SEQ ID NO: 3755 - protein, 9 aa, Homo Sapiens
SVLLAMAFD

SEQ ID NO: 3756 - protein, 9 aa, Homo Sapiens
FVAVSNPLR

SEQ ID NO: 3757 - protein, 9 aa, Homo Sapiens
SRIAQIGVA

SEQ ID NO: 3758 - protein, 9 aa, Homo Sapiens
SYCHSQVLH

SEQ ID NO: 3759 - protein, 9 aa, Homo Sapiens
SQVLHHSYC

SEQ ID NO: 3760 - protein, 9 aa, Homo Sapiens
SYCYHPDVM

SEQ ID NO: 3761 - protein, 9 aa, Homo Sapiens
VDLLLILLS

SEQ ID NO: 3762 - protein, 9 aa, Homo Sapiens
ETFSTCVSH

SEQ ID NO: 3763 - protein, 9 aa, Homo Sapiens
STCVSHIVA

SEQ ID NO: 3764 - protein, 9 aa, Homo Sapiens
SHIVAFAIY

SEQ ID NO: 3765 - protein, 9 aa, Homo Sapiens
PVIYSVKTK

SEQ ID NO: 3766 - protein, 9 aa, Homo Sapiens
SMLSATDLG

SEQ ID NO: 3767 - protein, 9 aa, Homo Sapiens
ISTLVTMLS

SEQ ID NO: 3768 - protein, 9 aa, Homo Sapiens
FNVREISFN

SEQ ID NO: 3769 - protein, 9 aa, Homo Sapiens
VREISFNAC

SEQ ID NO: 3770 - protein, 9 aa, Homo Sapiens
SFNACLSHM

SEQ ID NO: 3771 - protein, 9 aa, Homo Sapiens
FFTVMESSV

SEQ ID NO: 3772 - protein, 9 aa, Homo Sapiens
VMESSVLLA

SEQ ID NO: 3773 - protein, 9 aa, Homo Sapiens
DRFVAVSNP

SEQ ID NO: 3774 - protein, 9 aa, Homo Sapiens
VSNPLRYAM

SEQ ID NO: 3775 - protein, 9 aa, Homo Sapiens
IGVASVIRG

SEQ ID NO: 3776 - protein, 9 aa, Homo Sapiens
IRGLLMLTP

SEQ ID NO: 3777 - protein, 9 aa, Homo Sapiens
MVALLIRLS

SEQ ID NO: 3778 - protein, 9 aa, Homo Sapiens
HSQVLHHSY

SEQ ID NO: 3779 - protein, 9 aa, Homo Sapiens
HHSYCYHPD

SEQ ID NO: 3780 - protein, 9 aa, Homo Sapiens
SCTDTRINS

SEQ ID NO: 3781 - protein, 9 aa, Homo Sapiens
TDTRINSAV

SEQ ID NO: 3782 - protein, 9 aa, Homo Sapiens
NSAVGLTAM

SEQ ID NO: 3783 - protein, 9 aa, Homo Sapiens
LSYVLIIRT

SEQ ID NO: 3784 - protein, 9 aa, Homo Sapiens
RTVLSVASP

SEQ ID NO: 3785 - protein, 9 aa, Homo Sapiens
SVASPEERK

SEQ ID NO: 3786 - protein, 9 aa, Homo Sapiens
IVHRFGKQA

SEQ ID NO: 3787 - protein, 9 aa, Homo Sapiens
VKTKQIRRA

SEQ ID NO: 3788 - protein, 9 aa, Homo Sapiens
YYFLSMLSA

SEQ ID NO: 3789 - protein, 9 aa, Homo Sapiens
YFLSMLSAT

SEQ ID NO: 3790 - protein, 9 aa, Homo Sapiens
ATDLGLSIS

SEQ ID NO: 3791 - protein, 9 aa, Homo Sapiens
LSISTLVTM

SEQ ID NO: 3792 - protein, 9 aa, Homo Sapiens
FWFNVREIS

SEQ ID NO: 3793 - protein, 9 aa, Homo Sapiens
ISFNACLSH

SEQ ID NO: 3794 - protein, 9 aa, Homo Sapiens
HMFFIKFFT

SEQ ID NO: 3795 - protein, 9 aa, Homo Sapiens
FFIKFFTVM

SEQ ID NO: 3796 - protein, 9 aa, Homo Sapiens
MESSVLLAM

SEQ ID NO: 3797 - protein, 9 aa, Homo Sapiens
AFDRFVAVS

SEQ ID NO: 3798 - protein, 9 aa, Homo Sapiens
LRYAMILTD

SEQ ID NO: 3799 - protein, 9 aa, Homo Sapiens
RGLLMLTPM

SEQ ID NO: 3800 - protein, 9 aa, Homo Sapiens
IRLSYCHSQ

SEQ ID NO: 3801 - protein, 9 aa, Homo Sapiens
YCHSQVLHH

SEQ ID NO: 3802 - protein, 9 aa, Homo Sapiens
HSYCYHPDV

SEQ ID NO: 3803 - protein, 9 aa, Homo Sapiens
YCYHPDVMK

SEQ ID NO: 3804 - protein, 9 aa, Homo Sapiens
YHPDVMKLS

SEQ ID NO: 3805 - protein, 9 aa, Homo Sapiens
INSAVGLTA

SEQ ID NO: 3806 - protein, 9 aa, Homo Sapiens
AVGLTAMFS

SEQ ID NO: 3807 - protein, 9 aa, Homo Sapiens
VGLTAMFST

SEQ ID NO: 3808 - protein, 9 aa, Homo Sapiens
AMFSTVGVD

SEQ ID NO: 3809 - protein, 9 aa, Homo Sapiens
LSVASPEER

SEQ ID NO: 3810 - protein, 9 aa, Homo Sapiens
FSTCVSHIV

SEQ ID NO: 3811 - protein, 9 aa, Homo Sapiens
CVSHIVAFA

SEQ ID NO: 3812 - protein, 9 aa, Homo Sapiens
YYIPLISLS

SEQ ID NO: 3813 - protein, 9 aa, Homo Sapiens
LSIVHRFGK

SEQ ID NO: 3814 - protein, 9 aa, Homo Sapiens
RFGKQAPAY

SEQ ID NO: 3815 - protein, 9 aa, Homo Sapiens
GKQAPAYVH

SEQ ID NO: 3816 - protein, 9 aa, Homo Sapiens
KQAPAYVHT

SEQ ID NO: 3817 - protein, 9 aa, Homo Sapiens
AYVHTMIAN

SEQ ID NO: 3818 - protein, 9 aa, Homo Sapiens
YVHTMIANT

SEQ ID NO: 3819 - protein, 9 aa, Homo Sapiens
VHTMIANTY

SEQ ID NO: 3820 - protein, 9 aa, Homo Sapiens
ANTYLLISP

SEQ ID NO: 3821 - protein, 9 aa, Homo Sapiens
TYLLISPLM

SEQ ID NO: 3822 - protein, 9 aa, Homo Sapiens
LMNPVIYSV

SEQ ID NO: 3823 - protein, 9 aa, Homo Sapiens
MNPVIYSVK

SEQ ID NO: 3824 - protein, 9 aa, Homo Sapiens
RRAVIKILH

SEQ ID NO: 3825 - protein, 9 aa, Homo Sapiens
SHMFFIKFF

SEQ ID NO: 3826 - protein, 9 aa, Homo Sapiens
GVASVIRGL

SEQ ID NO: 3827 - protein, 9 aa, Homo Sapiens
LMLTPMVAL

SEQ ID NO: 3828 - protein, 9 aa, Homo Sapiens
TVMESSVLL

SEQ ID NO: 3829 - protein, 9 aa, Homo Sapiens
YVLIIRTVL

SEQ ID NO: 3830 - protein, 9 aa, Homo Sapiens
VASVIRGLL

SEQ ID NO: 3831 - protein, 9 aa, Homo Sapiens
MLTPMVALL

SEQ ID NO: 3832 - protein, 9 aa, Homo Sapiens
CYHPDVMKL

SEQ ID NO: 3833 - protein, 9 aa, Homo Sapiens
YHPDVMKLS

SEQ ID NO: 3834 - protein, 9 aa, Homo Sapiens
TRINSAVGL

SEQ ID NO: 3835 - protein, 9 aa, Homo Sapiens
MFSTVGVDL

SEQ ID NO: 3836 - protein, 9 aa, Homo Sapiens
FSTVGVDLL

SEQ ID NO: 3837 - protein, 9 aa, Homo Sapiens
IYYIPLISL

SEQ ID NO: 3838 - protein, 9 aa, Homo Sapiens
VHRFGKQAP

SEQ ID NO: 3839 - protein, 9 aa, Homo Sapiens
IRRAVIKIL

SEQ ID NO: 3840 - protein, 9 aa, Homo Sapiens
DLGLSISTL

SEQ ID NO: 3841 - protein, 9 aa, Homo Sapiens
SISTLVTML

SEQ ID NO: 3842 - protein, 9 aa, Homo Sapiens
FTVMESSVL

SEQ ID NO: 3843 - protein, 9 aa, Homo Sapiens
PMVALLIRL

SEQ ID NO: 3844 - protein, 9 aa, Homo Sapiens
LSYCHSQVL

SEQ ID NO: 3845 - protein, 9 aa, Homo Sapiens
CHSQVLHHS

SEQ ID NO: 3846 - protein, 9 aa, Homo Sapiens
LLILLSYVL

SEQ ID NO: 3847 - protein, 9 aa, Homo Sapiens
TMIANTYLL

SEQ ID NO: 3848 - protein, 9 aa, Homo Sapiens
MLSATDLGL

SEQ ID NO: 3849 - protein, 9 aa, Homo Sapiens
SVIRGLLML

SEQ ID NO: 3850 - protein, 9 aa, Homo Sapiens
HHSYCYHPD

SEQ ID NO: 3851 - protein, 9 aa, Homo Sapiens
STVGVDLLL

SEQ ID NO: 3852 - protein, 9 aa, Homo Sapiens
VGVDLLLIL

SEQ ID NO: 3853 - protein, 9 aa, Homo Sapiens
GVDLLLILL

SEQ ID NO: 3854 - protein, 9 aa, Homo Sapiens
TCVSHIVAF

SEQ ID NO: 3855 - protein, 9 aa, Homo Sapiens
SHIVAFAIY

SEQ ID NO: 3856 - protein, 9 aa, Homo Sapiens
AFAIYYIPL

SEQ ID NO: 3857 - protein, 9 aa, Homo Sapiens
ISLSIVHRF

SEQ ID NO: 3858 - protein, 9 aa, Homo Sapiens
VHTMIANTY

SEQ ID NO: 3859 - protein, 9 aa, Homo Sapiens
NTYLLISPL

SEQ ID NO: 3860 - protein, 9 aa, Homo Sapiens
LSMLSATDL

SEQ ID NO: 3861 - protein, 9 aa, Homo Sapiens
REISFNACL

SEQ ID NO: 3862 - protein, 9 aa, Homo Sapiens
RFVAVSNPL

SEQ ID NO: 3863 - protein, 9 aa, Homo Sapiens
VSNPLRYAM

SEQ ID NO: 3864 - protein, 9 aa, Homo Sapiens
NPLRYAMIL

SEQ ID NO: 3865 - protein, 9 aa, Homo Sapiens
LHHSYCYHP

SEQ ID NO: 3866 - protein, 9 aa, Homo Sapiens
NSAVGLTAM

SEQ ID NO: 3867 - protein, 9 aa, Homo Sapiens
SPEERKETF

SEQ ID NO: 3868 - protein, 9 aa, Homo Sapiens
HTMIANTYL

SEQ ID NO: 3869 - protein, 9 aa, Homo Sapiens
LSISTLVTM

SEQ ID NO: 3870 - protein, 9 aa, Homo Sapiens
FFIKFFTVM

SEQ ID NO: 3871 - protein, 9 aa, Homo Sapiens
LLAMAFDRF

SEQ ID NO: 3872 - protein, 9 aa, Homo Sapiens
SYCYHPDVM

SEQ ID NO: 3873 - protein, 9 aa, Homo Sapiens
MESSVLLAM

SEQ ID NO: 3874 - protein, 9 aa, Homo Sapiens
QAPAYVHTM

SEQ ID NO: 3875 - protein, 9 aa, Homo Sapiens
TYLLISPLM

SEQ ID NO: 3876 - protein, 9 aa, Homo Sapiens
TLVTMLSIF

SEQ ID NO: 3877 - protein, 9 aa, Homo Sapiens
VTMLSIFWF

SEQ ID NO: 3878 - protein, 9 aa, Homo Sapiens
IFWFNVREI

SEQ ID NO: 3879 - protein, 9 aa, Homo Sapiens
WFNVREISF

SEQ ID NO: 3880 - protein, 9 aa, Homo Sapiens
FNACLSHMF

SEQ ID NO: 3881 - protein, 9 aa, Homo Sapiens
SSVLLAMAF

SEQ ID NO: 3882 - protein, 9 aa, Homo Sapiens
SAVGLTAMF

SEQ ID NO: 3883 - protein, 9 aa, Homo Sapiens
SFNACLSHM

SEQ ID NO: 3884 - protein, 9 aa, Homo Sapiens
NACLSHMFF

SEQ ID NO: 3885 - protein, 9 aa, Homo Sapiens
LSHMFFIKF

SEQ ID NO: 3886 - protein, 9 aa, Homo Sapiens
ASVIRGLLM

SEQ ID NO: 3887 - protein, 9 aa, Homo Sapiens
RGLLMLTPM

SEQ ID NO: 3888 - protein, 9 aa, Homo Sapiens
IRTVLSVAS

SEQ ID NO: 3889 - protein, 9 aa, Homo Sapiens
VKTKQIRRA

SEQ ID NO: 3890 - protein, 9 aa, Homo Sapiens
ILTDSRIAQ

SEQ ID NO: 3891 - protein, 9 aa, Homo Sapiens
RIAQIGVAS

SEQ ID NO: 3892 - protein, 9 aa, Homo Sapiens
IGVASVIRG

SEQ ID NO: 3893 - protein, 9 aa, Homo Sapiens
VASPEERKE

SEQ ID NO: 3894 - protein, 9 aa, Homo Sapiens
KQAPAYVHT

SEQ ID NO: 3895 - protein, 9 aa, Homo Sapiens
ISPLMNPVI

SEQ ID NO: 3896 - protein, 9 aa, Homo Sapiens
KTKQIRRAV

SEQ ID NO: 3897 - protein, 9 aa, Homo Sapiens
GLSISTLVT

SEQ ID NO: 3898 - protein, 9 aa, Homo Sapiens
SIFWFNVRE

SEQ ID NO: 3899 - protein, 9 aa, Homo Sapiens
IKFFTVMES

SEQ ID NO: 3900 - protein, 9 aa, Homo Sapiens
AMAFDRFVA

SEQ ID NO: 3901 - protein, 9 aa, Homo Sapiens
MAFDRFVAV

SEQ ID NO: 3902 - protein, 9 aa, Homo Sapiens
VAVSNPLRY

SEQ ID NO: 3903 - protein, 9 aa, Homo Sapiens
AVSNPLRYA

SEQ ID NO: 3904 - protein, 9 aa, Homo Sapiens
IAQIGVASV

SEQ ID NO: 3905 - protein, 9 aa, Homo Sapiens
IRGLLMLTP

SEQ ID NO: 3906 - protein, 9 aa, Homo Sapiens
MVALLIRLS

SEQ ID NO: 3907 - protein, 9 aa, Homo Sapiens
YCYHPDVMK

SEQ ID NO: 3908 - protein, 9 aa, Homo Sapiens
INSAVGLTA

SEQ ID NO: 3909 - protein, 9 aa, Homo Sapiens
LSYVLIIRT

SEQ ID NO: 3910 - protein, 9 aa, Homo Sapiens
SYVLIIRTV

SEQ ID NO: 3911 - protein, 9 aa, Homo Sapiens
IIRTVLSVA

SEQ ID NO: 3912 - protein, 9 aa, Homo Sapiens
VLSVASPEE

SEQ ID NO: 3913 - protein, 9 aa, Homo Sapiens
SVASPEERK

SEQ ID NO: 3914 - protein, 9 aa, Homo Sapiens
IVAFAIYYI

SEQ ID NO: 3915 - protein, 9 aa, Homo Sapiens
YYIPLISLS

SEQ ID NO: 3916 - protein, 9 aa, Homo Sapiens
LISLSIVHR

SEQ ID NO: 3917 - protein, 9 aa, Homo Sapiens
GKQAPAYVH

SEQ ID NO: 3918 - protein, 9 aa, Homo Sapiens
LISPLMNPV

SEQ ID NO: 3919 - protein, 9 aa, Homo Sapiens
SPLMNPVIY

SEQ ID NO: 3920 - protein, 9 aa, Homo Sapiens
IYSVKTKQI

SEQ ID NO: 3921 - protein, 9 aa, Homo Sapiens
TKQIRRAVI

SEQ ID NO: 3922 - protein, 9 aa, Homo Sapiens
EISFNACLS

SEQ ID NO: 3923 - protein, 9 aa, Homo Sapiens
ESSVLLAMA

SEQ ID NO: 3924 - protein, 9 aa, Homo Sapiens
AFDRFVAVS

SEQ ID NO: 3925 - protein, 9 aa, Homo Sapiens
FVAVSNPLR

SEQ ID NO: 3926 - protein, 9 aa, Homo Sapiens
SRIAQIGVA

SEQ ID NO: 3927 - protein, 9 aa, Homo Sapiens
AQIGVASVI

SEQ ID NO: 3928 - protein, 9 aa, Homo Sapiens
QIGVASVIR

SEQ ID NO: 3929 - protein, 9 aa, Homo Sapiens
LLMLTPMVA

SEQ ID NO: 3930 - protein, 9 aa, Homo Sapiens
KLSCTDTRI

SEQ ID NO: 3931 - protein, 9 aa, Homo Sapiens
DTRINSAVG

SEQ ID NO: 3932 - protein, 9 aa, Homo Sapiens
LTAMFSTVG

SEQ ID NO: 3933 - protein, 9 aa, Homo Sapiens
TAMFSTVGV

SEQ ID NO: 3934 - protein, 9 aa, Homo Sapiens
AMFSTVGVD

SEQ ID NO: 3935 - protein, 9 aa, Homo Sapiens
ILLSYVLII

SEQ ID NO: 3936 - protein, 9 aa, Homo Sapiens
ASPEERKET

SEQ ID NO: 3937 - protein, 9 aa, Homo Sapiens
ERKETFSTC

SEQ ID NO: 3938 - protein, 9 aa, Homo Sapiens
ETFSTCVSH

SEQ ID NO: 3939 - protein, 9 aa, Homo Sapiens
TFSTCVSHI

SEQ ID NO: 3940 - protein, 9 aa, Homo Sapiens
STCVSHIVA

SEQ ID NO: 3941 - protein, 9 aa, Homo Sapiens
SLSIVHRFG

SEQ ID NO: 3942 - protein, 9 aa, Homo Sapiens
RFGKQAPAY

SEQ ID NO: 3943 - protein, 9 aa, Homo Sapiens
LMNPVIYSV

SEQ ID NO: 3944 - protein, 9 aa, Homo Sapiens
MNPVIYSVK

SEQ ID NO: 3945 - protein, 9 aa, Homo Sapiens
YSVKTKQIR

SEQ ID NO: 3946 - protein, 9 aa, Homo Sapiens
RRAVIKILH

SEQ ID NO: 3947 - protein, 9 aa, Homo Sapiens
IKILHSKET

SEQ ID NO: 3948 - protein, 9 aa, Homo Sapiens
YYFLSMLSA

SEQ ID NO: 3949 - protein, 9 aa, Homo Sapiens
YFLSMLSAT

SEQ ID NO: 3950 - protein, 9 aa, Homo Sapiens
FLSMLSATD

SEQ ID NO: 3951 - protein, 9 aa, Homo Sapiens
TDLGLSIST

SEQ ID NO: 3952 - protein, 9 aa, Homo Sapiens
ISTLVTMLS

SEQ ID NO: 3953 - protein, 9 aa, Homo Sapiens
STLVTMLSI

SEQ ID NO: 3954 - protein, 9 aa, Homo Sapiens
LSIFWFNVR

SEQ ID NO: 3955 - protein, 9 aa, Homo Sapiens
VREISFNAC

SEQ ID NO: 3956 - protein, 9 aa, Homo Sapiens
ISFNACLSH

SEQ ID NO: 3957 - protein, 9 aa, Homo Sapiens
FIKFFTVME

SEQ ID NO: 3958 - protein, 9 aa, Homo Sapiens
VMESSVLLA

SEQ ID NO: 3959 - protein, 9 aa, Homo Sapiens
LAMAFDRFV

SEQ ID NO: 3960 - protein, 9 aa, Homo Sapiens
FDRFVAVSN

SEQ ID NO: 3961 - protein, 9 aa, Homo Sapiens
DRFVAVSNP

SEQ ID NO: 3962 - protein, 9 aa, Homo Sapiens
LRYAMILTD

SEQ ID NO: 3963 - protein, 9 aa, Homo Sapiens
AMILTDSRI

SEQ ID NO: 3964 - protein, 9 aa, Homo Sapiens
MILTDSRIA

SEQ ID NO: 3965 - protein, 9 aa, Homo Sapiens
TDSRIAQIG

SEQ ID NO: 3966 - protein, 9 aa, Homo Sapiens
GLLMLTPMV

SEQ ID NO: 3967 - protein, 9 aa, Homo Sapiens
TPMVALLIR

SEQ ID NO: 3968 - protein, 9 aa, Homo Sapiens
IRLSYCHSQ

SEQ ID NO: 3969 - protein, 9 aa, Homo Sapiens
SYCHSQVLH

SEQ ID NO: 3970 - protein, 9 aa, Homo Sapiens
YCHSQVLHH

SEQ ID NO: 3971 - protein, 9 aa, Homo Sapiens
HPDVMKLSC

SEQ ID NO: 3972 - protein, 9 aa, Homo Sapiens
DVMKLSCTD

SEQ ID NO: 3973 - protein, 9 aa, Homo Sapiens
LSCTDTRIN

SEQ ID NO: 3974 - protein, 9 aa, Homo Sapiens
SCTDTRINS

SEQ ID NO: 3975 - protein, 9 aa, Homo Sapiens
TDTRINSAV

SEQ ID NO: 3976 - protein, 9 aa, Homo Sapiens
GLTAMFSTV

SEQ ID NO: 3977 - protein, 9 aa, Homo Sapiens
TVGVDLLLI

SEQ ID NO: 3978 - protein, 9 aa, Homo Sapiens
LILLSYVLI

SEQ ID NO: 3979 - protein, 9 aa, Homo Sapiens
VLIIRTVLS

SEQ ID NO: 3980 - protein, 9 aa, Homo Sapiens
LSVASPEER

SEQ ID NO: 3981 - protein, 9 aa, Homo Sapiens
EERKETFST

SEQ ID NO: 3982 - protein, 9 aa, Homo Sapiens
KETFSTCVS

SEQ ID NO: 3983 - protein, 9 aa, Homo Sapiens
CVSHIVAFA

SEQ ID NO: 3984 - protein, 9 aa, Homo Sapiens
FAIYYIPLI

SEQ ID NO: 3985 - protein, 9 aa, Homo Sapiens
IPLISLSIV

SEQ ID NO: 3986 - protein, 9 aa, Homo Sapiens
PLISLSIVH

SEQ ID NO: 3987 - protein, 9 aa, Homo Sapiens
LSIVHRFGK

SEQ ID NO: 3988 - protein, 9 aa, Homo Sapiens
IVHRFGKQA

SEQ ID NO: 3989 - protein, 9 aa, Homo Sapiens
FGKQAPAYV

SEQ ID NO: 3990 - protein, 9 aa, Homo Sapiens
AYVHTMIAN

SEQ ID NO: 3991 - protein, 9 aa, Homo Sapiens
YVHTMIANT

SEQ ID NO: 3992 - protein, 9 aa, Homo Sapiens
IANTYLLIS

SEQ ID NO: 3993 - protein, 9 aa, Homo Sapiens
YLLISPLMN

SEQ ID NO: 3994 - protein, 9 aa, Homo Sapiens
PLMNPVIYS

SEQ ID NO: 3995 - protein, 9 aa, Homo Sapiens
NPVIYSVKT

SEQ ID NO: 3996 - protein, 9 aa, Homo Sapiens
PVIYSVKTK

SEQ ID NO: 3997 - protein, 9 aa, Homo Sapiens
SVKTKQIRR

SEQ ID NO: 3998 - protein, 9 aa, Homo Sapiens
KQIRRAVIK

SEQ ID NO: 3999 - protein, 9 aa, Homo Sapiens
LSATDLGLS

SEQ ID NO: 4000 - protein, 9 aa, Homo Sapiens
SATDLGLSI

SEQ ID NO: 4001 - protein, 9 aa, Homo Sapiens
ATDLGLSIS

SEQ ID NO: 4002 - protein, 9 aa, Homo Sapiens
TMLSIFWFN

SEQ ID NO: 4003 - protein, 9 aa, Homo Sapiens
MLSIFWFNV

SEQ ID NO: 4004 - protein, 9 aa, Homo Sapiens
FWFNVREIS

SEQ ID NO: 4005 - protein, 9 aa, Homo Sapiens
FNVREISFN

SEQ ID NO: 4006 - protein, 9 aa, Homo Sapiens
NVREISFNA

SEQ ID NO: 4007 - protein, 9 aa, Homo Sapiens
ACLSHMFFI

SEQ ID NO: 4008 - protein, 9 aa, Homo Sapiens
CLSHMFFIK

SEQ ID NO: 4009 - protein, 9 aa, Homo Sapiens
HMFFIKFFT

SEQ ID NO: 4010 - protein, 9 aa, Homo Sapiens
MFFIKFFTV

SEQ ID NO: 4011 - protein, 9 aa, Homo Sapiens
KFFTVMESS

SEQ ID NO: 4012 - protein, 9 aa, Homo Sapiens
FFTVMESSV

SEQ ID NO: 4013 - protein, 9 aa, Homo Sapiens
SVLLAMAFD

SEQ ID NO: 4014 - protein, 9 aa, Homo Sapiens
PLRYAMILT

SEQ ID NO: 4015 - protein, 9 aa, Homo Sapiens
RYAMILTDS

SEQ ID NO: 4016 - protein, 9 aa, Homo Sapiens
YAMILTDSR

SEQ ID NO: 4017 - protein, 9 aa, Homo Sapiens
LTDSRIAQI

SEQ ID NO: 4018 - protein, 9 aa, Homo Sapiens
VIRGLLMLT

SEQ ID NO: 4019 - protein, 9 aa, Homo Sapiens
VALLIRLSY

SEQ ID NO: 4020 - protein, 9 aa, Homo Sapiens
RLSYCHSQV

SEQ ID NO: 4021 - protein, 9 aa, Homo Sapiens
HSQVLHHSY

SEQ ID NO: 4022 - protein, 9 aa, Homo Sapiens
HSYCYHPDV

SEQ ID NO: 4023 - protein, 9 aa, Homo Sapiens
MKLSCTDTR

SEQ ID NO: 4024 - protein, 9 aa, Homo Sapiens
CTDTRINSA

SEQ ID NO: 4025 - protein, 9 aa, Homo Sapiens
RINSAVGLT

SEQ ID NO: 4026 - protein, 9 aa, Homo Sapiens
VGLTAMFST

SEQ ID NO: 4027 - protein, 9 aa, Homo Sapiens
VDLLLILLS

SEQ ID NO: 4028 - protein, 9 aa, Homo Sapiens
LLSYVLIIR

SEQ ID NO: 4029 - protein, 9 aa, Homo Sapiens
LIIRTVLSV

SEQ ID NO: 4030 - protein, 9 aa, Homo Sapiens
RTVLSVASP

SEQ ID NO: 4031 - protein, 9 aa, Homo Sapiens
TVLSVASPE

SEQ ID NO: 4032 - protein, 9 aa, Homo Sapiens
PEERKETFS

SEQ ID NO: 4033 - protein, 9 aa, Homo Sapiens
RKETFSTCV

SEQ ID NO: 4034 - protein, 9 aa, Homo Sapiens
VSHIVAFAI

SEQ ID NO: 4035 - protein, 9 aa, Homo Sapiens
AIYYIPLIS

SEQ ID NO: 4036 - protein, 9 aa, Homo Sapiens
YIPLISLSI

SEQ ID NO: 4037 - protein, 9 aa, Homo Sapiens
HRFGKQAPA

SEQ ID NO: 4038 - protein, 9 aa, Homo Sapiens
APAYVHTMI

SEQ ID NO: 4039 - protein, 9 aa, Homo Sapiens
PAYVHTMIA

SEQ ID NO: 4040 - protein, 9 aa, Homo Sapiens
MIANTYLLI

SEQ ID NO: 4041 - protein, 9 aa, Homo Sapiens
LLISPLMNP

SEQ ID NO: 4042 - protein, 9 aa, Homo Sapiens
VIYSVKTKQ

SEQ ID NO: 4043 - protein, 9 aa, Homo Sapiens
QIRRAVIKI

SEQ ID NO: 4044 - protein, 9 aa, Homo Sapiens
RAVIKILHS

SEQ ID NO: 4045 - protein, 9 aa, Homo Sapiens
AVIKILHSK

SEQ ID NO: 4046 - protein, 9 aa, Homo Sapiens
TRINSAVGL

SEQ ID NO: 4047 - protein, 9 aa, Homo Sapiens
IRRAVIKIL

SEQ ID NO: 4048 - protein, 9 aa, Homo Sapiens
RRAVIKILH

SEQ ID NO: 4049 - protein, 9 aa, Homo Sapiens
HRFGKQAPA

SEQ ID NO: 4050 - protein, 9 aa, Homo Sapiens
REISFNACL

SEQ ID NO: 4051 - protein, 9 aa, Homo Sapiens
RFVAVSNPL

SEQ ID NO: 4052 - protein, 9 aa, Homo Sapiens
RGLLMLTPM

SEQ ID NO: 4053 - protein, 9 aa, Homo Sapiens
NTYLLISPL

SEQ ID NO: 4054 - protein, 9 aa, Homo Sapiens
AVIKILHSK

SEQ ID NO: 4055 - protein, 9 aa, Homo Sapiens
DLGLSISTL

SEQ ID NO: 4056 - protein, 9 aa, Homo Sapiens
DRFVAVSNP

SEQ ID NO: 4057 - protein, 9 aa, Homo Sapiens
LRYAMILTD

SEQ ID NO: 4058 - protein, 9 aa, Homo Sapiens
GVASVIRGL

SEQ ID NO: 4059 - protein, 9 aa, Homo Sapiens
GVDLLLILL

SEQ ID NO: 4060 - protein, 9 aa, Homo Sapiens
LLILLSYVL

SEQ ID NO: 4061 - protein, 9 aa, Homo Sapiens
IYYIPLISL

SEQ ID NO: 4062 - protein, 9 aa, Homo Sapiens
ISLSIVHRF

SEQ ID NO: 4063 - protein, 9 aa, Homo Sapiens
SRIAQIGVA

SEQ ID NO: 4064 - protein, 9 aa, Homo Sapiens
SVIRGLLML

SEQ ID NO: 4065 - protein, 9 aa, Homo Sapiens
PMVALLIRL

SEQ ID NO: 4066 - protein, 9 aa, Homo Sapiens
STVGVDLLL

SEQ ID NO: 4067 - protein, 9 aa, Homo Sapiens
YVLIIRTVL

SEQ ID NO: 4068 - protein, 9 aa, Homo Sapiens
LISLSIVHR

SEQ ID NO: 4069 - protein, 9 aa, Homo Sapiens
RFGKQAPAY

SEQ ID NO: 4070 - protein, 9 aa, Homo Sapiens
SVKTKQIRR

SEQ ID NO: 4071 - protein, 9 aa, Homo Sapiens
KQIRRAVIK

SEQ ID NO: 4072 - protein, 9 aa, Homo Sapiens
LSMLSATDL

SEQ ID NO: 4073 - protein, 9 aa, Homo Sapiens
VTMLSIFWF

SEQ ID NO: 4074 - protein, 9 aa, Homo Sapiens
FFIKFFTVM

SEQ ID NO: 4075 - protein, 9 aa, Homo Sapiens
FTVMESSVL

SEQ ID NO: 4076 - protein, 9 aa, Homo Sapiens
SSVLLAMAF

SEQ ID NO: 4077 - protein, 9 aa, Homo Sapiens
AQIGVASVI

SEQ ID NO: 4078 - protein, 9 aa, Homo Sapiens
IRGLLMLTP

SEQ ID NO: 4079 - protein, 9 aa, Homo Sapiens
YCYHPDVMK

SEQ ID NO: 4080 - protein, 9 aa, Homo Sapiens
CYHPDVMKL

SEQ ID NO: 4081 - protein, 9 aa, Homo Sapiens
SAVGLTAMF

SEQ ID NO: 4082 - protein, 9 aa, Homo Sapiens
DLLLILLSY

SEQ ID NO: 4083 - protein, 9 aa, Homo Sapiens
TCVSHIVAF

SEQ ID NO: 4084 - protein, 9 aa, Homo Sapiens
GKQAPAYVH

SEQ ID NO: 4085 - protein, 9 aa, Homo Sapiens
PVIYSVKTK

SEQ ID NO: 4086 - protein, 9 aa, Homo Sapiens
SISTLVTML

SEQ ID NO: 4087 - protein, 9 aa, Homo Sapiens
LSIFWFNVR

SEQ ID NO: 4088 - protein, 9 aa, Homo Sapiens
ISFNACLSH

SEQ ID NO: 4089 - protein, 9 aa, Homo Sapiens
TVMESSVLL

SEQ ID NO: 4090 - protein, 9 aa, Homo Sapiens
NPLRYAMIL

SEQ ID NO: 4091 - protein, 9 aa, Homo Sapiens
AMILTDSRI

SEQ ID NO: 4092 - protein, 9 aa, Homo Sapiens
LMLTPMVAL

SEQ ID NO: 4093 - protein, 9 aa, Homo Sapiens
VALLIRLSY

SEQ ID NO: 4094 - protein, 9 aa, Homo Sapiens
IRLSYCHSQ

SEQ ID NO: 4095 - protein, 9 aa, Homo Sapiens
LSYCHSQVL

SEQ ID NO: 4096 - protein, 9 aa, Homo Sapiens
VGVDLLLIL

SEQ ID NO: 4097 - protein, 9 aa, Homo Sapiens
IRTVLSVAS

SEQ ID NO: 4098 - protein, 9 aa, Homo Sapiens
PLISLSIVH

SEQ ID NO: 4099 - protein, 9 aa, Homo Sapiens
TYLLISPLM

SEQ ID NO: 4100 - protein, 9 aa, Homo Sapiens
YSVKTKQIR

SEQ ID NO: 4101 - protein, 9 aa, Homo Sapiens
LSISTLVTM

SEQ ID NO: 4102 - protein, 9 aa, Homo Sapiens
TLVTMLSIF

SEQ ID NO: 4103 - protein, 9 aa, Homo Sapiens
NACLSHMFF

SEQ ID NO: 4104 - protein, 9 aa, Homo Sapiens
LSHMFFIKF

SEQ ID NO: 4105 - protein, 9 aa, Homo Sapiens
SHMFFIKFF

SEQ ID NO: 4106 - protein, 9 aa, Homo Sapiens
VLLAMAFDR

SEQ ID NO: 4107 - protein, 9 aa, Homo Sapiens
FVAVSNPLR

SEQ ID NO: 4108 - protein, 9 aa, Homo Sapiens
MLTPMVALL

SEQ ID NO: 4109 - protein, 9 aa, Homo Sapiens
LLIRLSYCH

SEQ ID NO: 4110 - protein, 9 aa, Homo Sapiens
MKLSCTDTR

SEQ ID NO: 4111 - protein, 9 aa, Homo Sapiens
KLSCTDTRI

SEQ ID NO: 4112 - protein, 9 aa, Homo Sapiens
NSAVGLTAM

SEQ ID NO: 4113 - protein, 9 aa, Homo Sapiens
FSTVGVDLL

SEQ ID NO: 4114 - protein, 9 aa, Homo Sapiens
LLSYVLIIR

SEQ ID NO: 4115 - protein, 9 aa, Homo Sapiens
LSVASPEER

SEQ ID NO: 4116 - protein, 9 aa, Homo Sapiens
SVASPEERK

SEQ ID NO: 4117 - protein, 9 aa, Homo Sapiens
SPEERKETF

SEQ ID NO: 4118 - protein, 9 aa, Homo Sapiens
ERKETFSTC

SEQ ID NO: 4119 - protein, 9 aa, Homo Sapiens
ETFSTCVSH

SEQ ID NO: 4120 - protein, 9 aa, Homo Sapiens
HTMIANTYL

SEQ ID NO: 4121 - protein, 9 aa, Homo Sapiens
TMIANTYLL

SEQ ID NO: 4122 - protein, 9 aa, Homo Sapiens
MNPVIYSVK

SEQ ID NO: 4123 - protein, 9 aa, Homo Sapiens
MLSATDLGL

SEQ ID NO: 4124 - protein, 9 aa, Homo Sapiens
WFNVREISF

SEQ ID NO: 4125 - protein, 9 aa, Homo Sapiens
VREISFNAC

SEQ ID NO: 4126 - protein, 9 aa, Homo Sapiens
FNACLSHMF

SEQ ID NO: 4127 - protein, 9 aa, Homo Sapiens
LLAMAFDRF

SEQ ID NO: 4128 - protein, 9 aa, Homo Sapiens
VAVSNPLRY

SEQ ID NO: 4129 - protein, 9 aa, Homo Sapiens
YAMILTDSR

SEQ ID NO: 4130 - protein, 9 aa, Homo Sapiens
QIGVASVIR

SEQ ID NO: 4131 - protein, 9 aa, Homo Sapiens
TPMVALLIR

SEQ ID NO: 4132 - protein, 9 aa, Homo Sapiens
SYCHSQVLH

SEQ ID NO: 4133 - protein, 9 aa, Homo Sapiens
QVLHHSYCY

SEQ ID NO: 4134 - protein, 9 aa, Homo Sapiens
MFSTVGVDL

SEQ ID NO: 4135 - protein, 9 aa, Homo Sapiens
AFAIYYIPL

SEQ ID NO: 4136 - protein, 9 aa, Homo Sapiens
FAIYYIPLI

SEQ ID NO: 4137 - protein, 9 aa, Homo Sapiens
LSIVHRFGK

SEQ ID NO: 4138 - protein, 9 aa, Homo Sapiens
VHTMIANTY

SEQ ID NO: 4139 - protein, 9 aa, Homo Sapiens
MESSVLLAM

SEQ ID NO: 4140 - protein, 9 aa, Homo Sapiens
VSNPLRYAM

SEQ ID NO: 4141 - protein, 9 aa, Homo Sapiens
LTDSRIAQI

SEQ ID NO: 4142 - protein, 9 aa, Homo Sapiens
VASVIRGLL

SEQ ID NO: 4143 - protein, 9 aa, Homo Sapiens
ASVIRGLLM

SEQ ID NO: 4144 - protein, 9 aa, Homo Sapiens
LILLSYVLI

SEQ ID NO: 4145 - protein, 9 aa, Homo Sapiens
ILLSYVLII

SEQ ID NO: 4146 - protein, 9 aa, Homo Sapiens
SHIVAFAIY

SEQ ID NO: 4147 - protein, 9 aa, Homo Sapiens
HIVAFAIYY

SEQ ID NO: 4148 - protein, 9 aa, Homo Sapiens
IVAFAIYYI

SEQ ID NO: 4149 - protein, 9 aa, Homo Sapiens
YIPLISLSI

SEQ ID NO: 4150 - protein, 9 aa, Homo Sapiens
ISPLMNPVI

SEQ ID NO: 4151 - protein, 9 aa, Homo Sapiens
SPLMNPVIY

SEQ ID NO: 4152 - protein, 9 aa, Homo Sapiens
STLVTMLSI

SEQ ID NO: 4153 - protein, 9 aa, Homo Sapiens
SFNACLSHM

SEQ ID NO: 4154 - protein, 9 aa, Homo Sapiens
CLSHMFFIK

SEQ ID NO: 4155 - protein, 9 aa, Homo Sapiens
YCHSQVLHH

SEQ ID NO: 4156 - protein, 9 aa, Homo Sapiens
HSQVLHHSY

SEQ ID NO: 4157 - protein, 9 aa, Homo Sapiens
RTVLSVASP

SEQ ID NO: 4158 - protein, 9 aa, Homo Sapiens
QAPAYVHTM

SEQ ID NO: 4159 - protein, 9 aa, Homo Sapiens
APAYVHTMI

SEQ ID NO: 4160 - protein, 9 aa, Homo Sapiens
QIRRAVIKI

SEQ ID NO: 4161 - protein, 9 aa, Homo Sapiens
RAVIKILHS

SEQ ID NO: 4162 - protein, 9 aa, Homo Sapiens
SATDLGLSI

SEQ ID NO: 4163 - protein, 9 aa, Homo Sapiens
IFWFNVREI

SEQ ID NO: 4164 - protein, 9 aa, Homo Sapiens
ACLSHMFFI

SEQ ID NO: 4165 - protein, 9 aa, Homo Sapiens
LTPMVALLI

SEQ ID NO: 4166 - protein, 9 aa, Homo Sapiens
VLHHSYCYH

SEQ ID NO: 4167 - protein, 9 aa, Homo Sapiens
SYCYHPDVM

SEQ ID NO: 4168 - protein, 9 aa, Homo Sapiens
LSYVLIIRT

SEQ ID NO: 4169 - protein, 9 aa, Homo Sapiens
IYSVKTKQI

SEQ ID NO: 4170 - protein, 9 aa, Homo Sapiens
TDLGLSIST

SEQ ID NO: 4171 - protein, 9 aa, Homo Sapiens
SNPLRYAMI

SEQ ID NO: 4172 - protein, 9 aa, Homo Sapiens
RYAMILTDS

SEQ ID NO: 4173 - protein, 9 aa, Homo Sapiens
RIAQIGVAS

SEQ ID NO: 4174 - protein, 9 aa, Homo Sapiens
TVGVDLLLI

SEQ ID NO: 4175 - protein, 9 aa, Homo Sapiens
VDLLLILLS

SEQ ID NO: 4176 - protein, 9 aa, Homo Sapiens
TFSTCVSHI

SEQ ID NO: 4177 - protein, 9 aa, Homo Sapiens
VSHIVAFAI

SEQ ID NO: 4178 - protein, 9 aa, Homo Sapiens
YYIPLISLS

SEQ ID NO: 4179 - protein, 9 aa, Homo Sapiens
VIYSVKTKQ

SEQ ID NO: 4180 - protein, 9 aa, Homo Sapiens
TKQIRRAVI

SEQ ID NO: 4181 - protein, 9 aa, Homo Sapiens
YYFLSMLSA

SEQ ID NO: 4182 - protein, 9 aa, Homo Sapiens
SIFWFNVRE

SEQ ID NO: 4183 - protein, 9 aa, Homo Sapiens
IKFFTVMES

SEQ ID NO: 4184 - protein, 9 aa, Homo Sapiens
KFFTVMESS

SEQ ID NO: 4185 - protein, 9 aa, Homo Sapiens
IGVASVIRG

SEQ ID NO: 4186 - protein, 9 aa, Homo Sapiens
GLLMLTPMV

SEQ ID NO: 4187 - protein, 9 aa, Homo Sapiens
SYVLIIRTV

SEQ ID NO: 4188 - protein, 9 aa, Homo Sapiens
RKETFSTCV

SEQ ID NO: 4189 - protein, 9 aa, Homo Sapiens
MIANTYLLI

SEQ ID NO: 4190 - protein, 9 aa, Homo Sapiens
LLISPLMNP

SEQ ID NO: 4191 - protein, 9 aa, Homo Sapiens
LMNPVIYSV

SEQ ID NO: 4192 - protein, 9 aa, Homo Sapiens
VKTKQIRRA

SEQ ID NO: 4193 - protein, 9 aa, Homo Sapiens
ATDLGLSIS

SEQ ID NO: 4194 - protein, 9 aa, Homo Sapiens
LGLSISTLV

SEQ ID NO: 4195 - protein, 9 aa, Homo Sapiens
GLSISTLVT

SEQ ID NO: 4196 - protein, 9 aa, Homo Sapiens
FNVREISFN

SEQ ID NO: 4197 - protein, 9 aa, Homo Sapiens
IAQIGVASV

SEQ ID NO: 4198 - protein, 9 aa, Homo Sapiens
RLSYCHSQV

SEQ ID NO: 4199 - protein, 9 aa, Homo Sapiens
AMFSTVGVD

SEQ ID NO: 4200 - protein, 9 aa, Homo Sapiens
IPLISLSIV

SEQ ID NO: 4201 - protein, 9 aa, Homo Sapiens
YVHTMIANT

SEQ ID NO: 4202 - protein, 9 aa, Homo Sapiens
IKILHSKET

SEQ ID NO: 4203 - protein, 9 aa, Homo Sapiens
MYYFLSMLS

SEQ ID NO: 4204 - protein, 9 aa, Homo Sapiens
NVREISFNA

SEQ ID NO: 4205 - protein, 9 aa, Homo Sapiens
HMFFIKFFT

SEQ ID NO: 4206 - protein, 9 aa, Homo Sapiens
MFFIKFFTV

SEQ ID NO: 4207 - protein, 9 aa, Homo Sapiens
VIRGLLMLT

SEQ ID NO: 4208 - protein, 9 aa, Homo Sapiens
MVALLIRLS

SEQ ID NO: 4209 - protein, 9 aa, Homo Sapiens
ALLIRLSYC

SEQ ID NO: 4210 - protein, 9 aa, Homo Sapiens
DVMKLSCTD

SEQ ID NO: 4211 - protein, 9 aa, Homo Sapiens
CTDTRINSA

SEQ ID NO: 4212 - protein, 9 aa, Homo Sapiens
RINSAVGLT

SEQ ID NO: 4213 - protein, 9 aa, Homo Sapiens
GLTAMFSTV

SEQ ID NO: 4214 - protein, 9 aa, Homo Sapiens
LLLILLSYV

SEQ ID NO: 4215 - protein, 9 aa, Homo Sapiens
LIIRTVLSV

SEQ ID NO: 4216 - protein, 9 aa, Homo Sapiens
IIRTVLSVA

SEQ ID NO: 4217 - protein, 9 aa, Homo Sapiens
TVLSVASPE

SEQ ID NO: 4218 - protein, 9 aa, Homo Sapiens
VAFAIYYIP

SEQ ID NO: 4219 - protein, 9 aa, Homo Sapiens
AIYYIPLIS

SEQ ID NO: 4220 - protein, 9 aa, Homo Sapiens
ANTYLLISP

SEQ ID NO: 4221 - protein, 9 aa, Homo Sapiens
NPVIYSVKT

SEQ ID NO: 4222 - protein, 9 aa, Homo Sapiens
KTKQIRRAV

SEQ ID NO: 4223 - protein, 9 aa, Homo Sapiens
YFLSMLSAT

SEQ ID NO: 4224 - protein, 9 aa, Homo Sapiens
FLSMLSATD

SEQ ID NO: 4225 - protein, 9 aa, Homo Sapiens
ISTLVTMLS

SEQ ID NO: 4226 - protein, 9 aa, Homo Sapiens
TMLSIFWFN

SEQ ID NO: 4227 - protein, 9 aa, Homo Sapiens
FWFNVREIS

SEQ ID NO: 4228 - protein, 9 aa, Homo Sapiens
SVLLAMAFD

SEQ ID NO: 4229 - protein, 9 aa, Homo Sapiens
MAFDRFVAV

SEQ ID NO: 4230 - protein, 9 aa, Homo Sapiens
AFDRFVAVS

SEQ ID NO: 4231 - protein, 9 aa, Homo Sapiens
FDRFVAVSN

SEQ ID NO: 4232 - protein, 9 aa, Homo Sapiens
CHSQVLHHS

SEQ ID NO: 4233 - protein, 9 aa, Homo Sapiens
PDVMKLSCT

SEQ ID NO: 4234 - protein, 9 aa, Homo Sapiens
VMKLSCTDT

SEQ ID NO: 4235 - protein, 9 aa, Homo Sapiens
INSAVGLTA

SEQ ID NO: 4236 - protein, 9 aa, Homo Sapiens
AVGLTAMFS

SEQ ID NO: 4237 - protein, 9 aa, Homo Sapiens
LTAMFSTVG

SEQ ID NO: 4238 - protein, 9 aa, Homo Sapiens
VASPEERKE

SEQ ID NO: 4239 - protein, 9 aa, Homo Sapiens
ASPEERKET

SEQ ID NO: 4240 - protein, 9 aa, Homo Sapiens
EERKETFST

SEQ ID NO: 4241 - protein, 9 aa, Homo Sapiens
KETFSTCVS

SEQ ID NO: 4242 - protein, 9 aa, Homo Sapiens
KQAPAYVHT

SEQ ID NO: 4243 - protein, 9 aa, Homo Sapiens
YLLISPLMN

SEQ ID NO: 4244 - protein, 9 aa, Homo Sapiens
VIKILHSKE

SEQ ID NO: 4245 - protein, 9 aa, Homo Sapiens
LVTMLSIFW

SEQ ID NO: 4246 - protein, 9 aa, Homo Sapiens
VMESSVLLA

SEQ ID NO: 4247 - protein, 9 aa, Homo Sapiens
ESSVLLAMA

SEQ ID NO: 4248 - protein, 9 aa, Homo Sapiens
AVSNPLRYA

SEQ ID NO: 4249 - protein, 9 aa, Homo Sapiens
MILTDSRIA

SEQ ID NO: 4250 - protein, 9 aa, Homo Sapiens
ILTDSRIAQ

SEQ ID NO: 4251 - protein, 9 aa, Homo Sapiens
DSRIAQIGV

SEQ ID NO: 4252 - protein, 9 aa, Homo Sapiens
LLMLTPMVA

SEQ ID NO: 4253 - protein, 9 aa, Homo Sapiens
SQVLHHSYC

SEQ ID NO: 4254 - protein, 9 aa, Homo Sapiens
HSYCYHPDV

SEQ ID NO: 4255 - protein, 9 aa, Homo Sapiens
HPDVMKLSC

SEQ ID NO: 4256 - protein, 9 aa, Homo Sapiens
SCTDTRINS

SEQ ID NO: 4257 - protein, 9 aa, Homo Sapiens
TDTRINSAV

SEQ ID NO: 4258 - protein, 9 aa, Homo Sapiens
DTRINSAVG

SEQ ID NO: 4259 - protein, 9 aa, Homo Sapiens
VGLTAMFST

SEQ ID NO: 4260 - protein, 9 aa, Homo Sapiens
VLIIRTVLS

SEQ ID NO: 4261 - protein, 9 aa, Homo Sapiens
VLSVASPEE

SEQ ID NO: 4262 - protein, 9 aa, Homo Sapiens
PEERKETFS

SEQ ID NO: 4263 - protein, 9 aa, Homo Sapiens
STCVSHIVA

SEQ ID NO: 4264 - protein, 9 aa, Homo Sapiens
CVSHIVAFA

SEQ ID NO: 4265 - protein, 9 aa, Homo Sapiens
SIVHRFGKQ

SEQ ID NO: 4266 - protein, 9 aa, Homo Sapiens
VHRFGKQAP

SEQ ID NO: 4267 - protein, 9 aa, Homo Sapiens
FGKQAPAYV

SEQ ID NO: 4268 - protein, 9 aa, Homo Sapiens
PAYVHTMIA

SEQ ID NO: 4269 - protein, 9 aa, Homo Sapiens
AYVHTMIAN

SEQ ID NO: 4270 - protein, 9 aa, Homo Sapiens
IANTYLLIS

SEQ ID NO: 4271 - protein, 9 aa, Homo Sapiens
LISPLMNPV

SEQ ID NO: 4272 - protein, 9 aa, Homo Sapiens
PLMNPVIYS

SEQ ID NO: 4273 - protein, 9 aa, Homo Sapiens
SMLSATDLG

SEQ ID NO: 4274 - protein, 9 aa, Homo Sapiens
MLSIFWFNV

SEQ ID NO: 4275 - protein, 9 aa, Homo Sapiens
FFTVMESSV

SEQ ID NO: 4276 - protein, 9 aa, Homo Sapiens
AMAFDRFVA

SEQ ID NO: 4277 - protein, 9 aa, Homo Sapiens
TDSRIAQIG

SEQ ID NO: 4278 - protein, 9 aa, Homo Sapiens
LIRLSYCHS

SEQ ID NO: 4279 - protein, 9 aa, Homo Sapiens
TAMFSTVGV

SEQ ID NO: 4280 - protein, 9 aa, Homo Sapiens
FSTCVSHIV

SEQ ID NO: 4281 - protein, 9 aa, Homo Sapiens
IVHRFGKQA

SEQ ID NO: 4282 - protein, 9 aa, Homo Sapiens
LSATDLGLS

SEQ ID NO: 4283 - protein, 9 aa, Homo Sapiens
EISFNACLS

SEQ ID NO: 4284 - protein, 9 aa, Homo Sapiens
FIKFFTVME

SEQ ID NO: 4285 - protein, 9 aa, Homo Sapiens
LAMAFDRFV

SEQ ID NO: 4286 - protein, 9 aa, Homo Sapiens
PLRYAMILT

SEQ ID NO: 4287 - protein, 9 aa, Homo Sapiens
LHHSYCYHP

SEQ ID NO: 4288 - protein, 9 aa, Homo Sapiens
YHPDVMKLS

SEQ ID NO: 4289 - protein, 9 aa, Homo Sapiens
SLSIVHRFG

SEQ ID NO: 4290 - protein, 9 aa, Homo Sapiens
TRINSAVGL

SEQ ID NO: 4291 - protein, 9 aa, Homo Sapiens
IRRAVIKIL

SEQ ID NO: 4292 - protein, 9 aa, Homo Sapiens
REISFNACL

SEQ ID NO: 4293 - protein, 9 aa, Homo Sapiens
RFVAVSNPL

SEQ ID NO: 4294 - protein, 9 aa, Homo Sapiens
ISLSIVHRF

SEQ ID NO: 4295 - protein, 9 aa, Homo Sapiens
RRAVIKILH

SEQ ID NO: 4296 - protein, 9 aa, Homo Sapiens
DRFVAVSNP

SEQ ID NO: 4297 - protein, 9 aa, Homo Sapiens
GVASVIRGL

SEQ ID NO: 4298 - protein, 9 aa, Homo Sapiens
RGLLMLTPM

SEQ ID NO: 4299 - protein, 9 aa, Homo Sapiens
GLLMLTPMV

SEQ ID NO: 4300 - protein, 9 aa, Homo Sapiens
IRLSYCHSQ

SEQ ID NO: 4301 - protein, 9 aa, Homo Sapiens
ILLSYVLII

SEQ ID NO: 4302 - protein, 9 aa, Homo Sapiens
NPLRYAMIL

SEQ ID NO: 4303 - protein, 9 aa, Homo Sapiens
LRYAMILTD

SEQ ID NO: 4304 - protein, 9 aa, Homo Sapiens
LMLTPMVAL

SEQ ID NO: 4305 - protein, 9 aa, Homo Sapiens
MLTPMVALL

SEQ ID NO: 4306 - protein, 9 aa, Homo Sapiens
RLSYCHSQV

SEQ ID NO: 4307 - protein, 9 aa, Homo Sapiens
CYHPDVMKL

SEQ ID NO: 4308 - protein, 9 aa, Homo Sapiens
GVDLLLILL

SEQ ID NO: 4309 - protein, 9 aa, Homo Sapiens
YVLIIRTVL

SEQ ID NO: 4310 - protein, 9 aa, Homo Sapiens
IRTVLSVAS

SEQ ID NO: 4311 - protein, 9 aa, Homo Sapiens
IYYIPLISL

SEQ ID NO: 4312 - protein, 9 aa, Homo Sapiens
LGLSISTLV

SEQ ID NO: 4313 - protein, 9 aa, Homo Sapiens
ACLSHMFFI

SEQ ID NO: 4314 - protein, 9 aa, Homo Sapiens
SVIRGLLML

SEQ ID NO: 4315 - protein, 9 aa, Homo Sapiens
IRGLLMLTP

SEQ ID NO: 4316 - protein, 9 aa, Homo Sapiens
PMVALLIRL

SEQ ID NO: 4317 - protein, 9 aa, Homo Sapiens
LSYCHSQVL

SEQ ID NO: 4318 - protein, 9 aa, Homo Sapiens
GLTAMFSTV

SEQ ID NO: 4319 - protein, 9 aa, Homo Sapiens
FSTVGVDLL

SEQ ID NO: 4320 - protein, 9 aa, Homo Sapiens
STVGVDLLL

SEQ ID NO: 4321 - protein, 9 aa, Homo Sapiens
VGVDLLLIL

SEQ ID NO: 4322 - protein, 9 aa, Homo Sapiens
LLILLSYVL

SEQ ID NO: 4323 - protein, 9 aa, Homo Sapiens
RKETFSTCV

SEQ ID NO: 4324 - protein, 9 aa, Homo Sapiens
HRFGKQAPA

SEQ ID NO: 4325 - protein, 9 aa, Homo Sapiens
TMIANTYLL

SEQ ID NO: 4326 - protein, 9 aa, Homo Sapiens
NTYLLISPL

SEQ ID NO: 4327 - protein, 9 aa, Homo Sapiens
TYLLISPLM

SEQ ID NO: 4328 - protein, 9 aa, Homo Sapiens
LSMLSATDL

SEQ ID NO: 4329 - protein, 9 aa, Homo Sapiens
MLSATDLGL

SEQ ID NO: 4330 - protein, 9 aa, Homo Sapiens
LSISTLVTM

SEQ ID NO: 4331 - protein, 9 aa, Homo Sapiens
SISTLVTML

SEQ ID NO: 4332 - protein, 9 aa, Homo Sapiens
STLVTMLSI

SEQ ID NO: 4333 - protein, 9 aa, Homo Sapiens
FTVMESSVL

SEQ ID NO: 4334 - protein, 9 aa, Homo Sapiens
TVMESSVLL

SEQ ID NO: 4335 - protein, 9 aa, Homo Sapiens
MAFDRFVAV

SEQ ID NO: 4336 - protein, 9 aa, Homo Sapiens
AMILTDSRI

SEQ ID NO: 4337 - protein, 9 aa, Homo Sapiens
SRIAQIGVA

SEQ ID NO: 4338 - protein, 9 aa, Homo Sapiens
AQIGVASVI

SEQ ID NO: 4339 - protein, 9 aa, Homo Sapiens
VASVIRGLL

SEQ ID NO: 4340 - protein, 9 aa, Homo Sapiens
ASVIRGLLM

SEQ ID NO: 4341 - protein, 9 aa, Homo Sapiens
HSYCYHPDV

SEQ ID NO: 4342 - protein, 9 aa, Homo Sapiens
KLSCTDTRI

SEQ ID NO: 4343 - protein, 9 aa, Homo Sapiens
MFSTVGVDL

SEQ ID NO: 4344 - protein, 9 aa, Homo Sapiens
LILLSYVLI

SEQ ID NO: 4345 - protein, 9 aa, Homo Sapiens
LIIRTVLSV

SEQ ID NO: 4346 - protein, 9 aa, Homo Sapiens
TCVSHIVAF

SEQ ID NO: 4347 - protein, 9 aa, Homo Sapiens
AFAIYYIPL

SEQ ID NO: 4348 - protein, 9 aa, Homo Sapiens
IPLISLSIV

SEQ ID NO: 4349 - protein, 9 aa, Homo Sapiens
KTKQIRRAV

SEQ ID NO: 4350 - protein, 9 aa, Homo Sapiens
SATDLGLSI

SEQ ID NO: 4351 - protein, 9 aa, Homo Sapiens
DLGLSISTL

SEQ ID NO: 4352 - protein, 9 aa, Homo Sapiens
IFWFNVREI

SEQ ID NO: 4353 - protein, 9 aa, Homo Sapiens
VREISFNAC

SEQ ID NO: 4354 - protein, 9 aa, Homo Sapiens
MFFIKFFTV

SEQ ID NO: 4355 - protein, 9 aa, Homo Sapiens
MESSVLLAM

SEQ ID NO: 4356 - protein, 9 aa, Homo Sapiens
SSVLLAMAF

SEQ ID NO: 4357 - protein, 9 aa, Homo Sapiens
VSNPLRYAM

SEQ ID NO: 4358 - protein, 9 aa, Homo Sapiens
LTDSRIAQI

SEQ ID NO: 4359 - protein, 9 aa, Homo Sapiens
IAQIGVASV

SEQ ID NO: 4360 - protein, 9 aa, Homo Sapiens
LTPMVALLI

SEQ ID NO: 4361 - protein, 9 aa, Homo Sapiens
TDTRINSAV

SEQ ID NO: 4362 - protein, 9 aa, Homo Sapiens
TVGVDLLLI

SEQ ID NO: 4363 - protein, 9 aa, Homo Sapiens
LLLILLSYV

SEQ ID NO: 4364 - protein, 9 aa, Homo Sapiens
SYVLIIRTV

SEQ ID NO: 4365 - protein, 9 aa, Homo Sapiens
ERKETFSTC

SEQ ID NO: 4366 - protein, 9 aa, Homo Sapiens
IVAFAIYYI

SEQ ID NO: 4367 - protein, 9 aa, Homo Sapiens
FAIYYIPLI

SEQ ID NO: 4368 - protein, 9 aa, Homo Sapiens
YIPLISLSI

SEQ ID NO: 4369 - protein, 9 aa, Homo Sapiens
HTMIANTYL

SEQ ID NO: 4370 - protein, 9 aa, Homo Sapiens
ISPLMNPVI

SEQ ID NO: 4371 - protein, 9 aa, Homo Sapiens
LMNPVIYSV

SEQ ID NO: 4372 - protein, 9 aa, Homo Sapiens
IYSVKTKQI

SEQ ID NO: 4373 - protein, 9 aa, Homo Sapiens
TLVTMLSIF

SEQ ID NO: 4374 - protein, 9 aa, Homo Sapiens
MLSIFWFNV

SEQ ID NO: 4375 - protein, 9 aa, Homo Sapiens
FFIKFFTVM

SEQ ID NO: 4376 - protein, 9 aa, Homo Sapiens
FFTVMESSV

SEQ ID NO: 4377 - protein, 9 aa, Homo Sapiens
LLAMAFDRF

SEQ ID NO: 4378 - protein, 9 aa, Homo Sapiens
SAVGLTAMF

SEQ ID NO: 4379 - protein, 9 aa, Homo Sapiens
TAMFSTVGV

SEQ ID NO: 4380 - protein, 9 aa, Homo Sapiens
TFSTCVSHI

SEQ ID NO: 4381 - protein, 9 aa, Homo Sapiens
FSTCVSHIV

SEQ ID NO: 4382 - protein, 9 aa, Homo Sapiens
VSHIVAFAI

SEQ ID NO: 4383 - protein, 9 aa, Homo Sapiens
QAPAYVHTM

SEQ ID NO: 4384 - protein, 9 aa, Homo Sapiens
APAYVHTMI

SEQ ID NO: 4385 - protein, 9 aa, Homo Sapiens
MIANTYLLI

SEQ ID NO: 4386 - protein, 9 aa, Homo Sapiens
LISPLMNPV

SEQ ID NO: 4387 - protein, 9 aa, Homo Sapiens
QIRRAVIKI

SEQ ID NO: 4388 - protein, 9 aa, Homo Sapiens
VTMLSIFWF

SEQ ID NO: 4389 - protein, 9 aa, Homo Sapiens
WFNVREISF

SEQ ID NO: 4390 - protein, 9 aa, Homo Sapiens
SFNACLSHM

SEQ ID NO: 4391 - protein, 9 aa, Homo Sapiens
FNACLSHMF

SEQ ID NO: 4392 - protein, 9 aa, Homo Sapiens
NACLSHMFF

SEQ ID NO: 4393 - protein, 9 aa, Homo Sapiens
LSHMFFIKF

SEQ ID NO: 4394 - protein, 9 aa, Homo Sapiens
SHMFFIKFF

SEQ ID NO: 4395 - protein, 9 aa, Homo Sapiens
LAMAFDRFV

SEQ ID NO: 4396 - protein, 9 aa, Homo Sapiens
SNPLRYAMI

SEQ ID NO: 4397 - protein, 9 aa, Homo Sapiens
DSRIAQIGV

SEQ ID NO: 4398 - protein, 9 aa, Homo Sapiens
SYCYHPDVM

SEQ ID NO: 4399 - protein, 9 aa, Homo Sapiens
NSAVGLTAM

SEQ ID NO: 4400 - protein, 9 aa, Homo Sapiens
SPEERKETF

SEQ ID NO: 4401 - protein, 9 aa, Homo Sapiens
FGKQAPAYV

SEQ ID NO: 4402 - protein, 9 aa, Homo Sapiens
TKQIRRAVI

SEQ ID NO: 4403 - protein, 9 aa, Homo Sapiens
RIAQIGVAS

SEQ ID NO: 4404 - protein, 9 aa, Homo Sapiens
RINSAVGLT

SEQ ID NO: 4405 - protein, 9 aa, Homo Sapiens
RTVLSVASP

SEQ ID NO: 4406 - protein, 9 aa, Homo Sapiens
RFGKQAPAY

SEQ ID NO: 4407 - protein, 9 aa, Homo Sapiens
RAVIKILHS

SEQ ID NO: 4408 - protein, 9 aa, Homo Sapiens
RYAMILTDS

SEQ ID NO: 4409 - protein, 9 aa, Homo Sapiens
AMFSTVGVD

SEQ ID NO: 4410 - protein, 9 aa, Homo Sapiens
AIYYIPLIS

SEQ ID NO: 4411 - protein, 9 aa, Homo Sapiens
GKQAPAYVH

SEQ ID NO: 4412 - protein, 9 aa, Homo Sapiens
KQIRRAVIK

SEQ ID NO: 4413 - protein, 9 aa, Homo Sapiens
GLSISTLVT

SEQ ID NO: 4414 - protein, 9 aa, Homo Sapiens
TMLSIFWFN

SEQ ID NO: 4415 - protein, 9 aa, Homo Sapiens
SIFWFNVRE

SEQ ID NO: 4416 - protein, 9 aa, Homo Sapiens
ISFNACLSH

SEQ ID NO: 4417 - protein, 9 aa, Homo Sapiens
IKFFTVMES

SEQ ID NO: 4418 - protein, 9 aa, Homo Sapiens
KFFTVMESS

SEQ ID NO: 4419 - protein, 9 aa, Homo Sapiens
VAVSNPLRY

SEQ ID NO: 4420 - protein, 9 aa, Homo Sapiens
IGVASVIRG

SEQ ID NO: 4421 - protein, 9 aa, Homo Sapiens
VALLIRLSY

SEQ ID NO: 4422 - protein, 9 aa, Homo Sapiens
DLLLILLSY

SEQ ID NO: 4423 - protein, 9 aa, Homo Sapiens
TVLSVASPE

SEQ ID NO: 4424 - protein, 9 aa, Homo Sapiens
ETFSTCVSH

SEQ ID NO: 4425 - protein, 9 aa, Homo Sapiens
VAFAIYYIP

SEQ ID NO: 4426 - protein, 9 aa, Homo Sapiens
KQAPAYVHT

SEQ ID NO: 4427 - protein, 9 aa, Homo Sapiens
YYFLSMLSA

SEQ ID NO: 4428 - protein, 9 aa, Homo Sapiens
YFLSMLSAT

SEQ ID NO: 4429 - protein, 9 aa, Homo Sapiens
SMLSATDLG

SEQ ID NO: 4430 - protein, 9 aa, Homo Sapiens
HMFFIKFFT

SEQ ID NO: 4431 - protein, 9 aa, Homo Sapiens
VMESSVLLA

SEQ ID NO: 4432 - protein, 9 aa, Homo Sapiens
VLLAMAFDR

SEQ ID NO: 4433 - protein, 9 aa, Homo Sapiens
MILTDSRIA

SEQ ID NO: 4434 - protein, 9 aa, Homo Sapiens
ALLIRLSYC

SEQ ID NO: 4435 - protein, 9 aa, Homo Sapiens
YCHSQVLHH

SEQ ID NO: 4436 - protein, 9 aa, Homo Sapiens
QVLHHSYCY

SEQ ID NO: 4437 - protein, 9 aa, Homo Sapiens
YCYHPDVMK

SEQ ID NO: 4438 - protein, 9 aa, Homo Sapiens
MKLSCTDTR

SEQ ID NO: 4439 - protein, 9 aa, Homo Sapiens
VDLLLILLS

SEQ ID NO: 4440 - protein, 9 aa, Homo Sapiens
LSYVLIIRT

SEQ ID NO: 4441 - protein, 9 aa, Homo Sapiens
KETFSTCVS

SEQ ID NO: 4442 - protein, 9 aa, Homo Sapiens
VHTMIANTY

SEQ ID NO: 4443 - protein, 9 aa, Homo Sapiens
YLLISPLMN

SEQ ID NO: 4444 - protein, 9 aa, Homo Sapiens
LLISPLMNP

SEQ ID NO: 4445 - protein, 9 aa, Homo Sapiens
SPLMNPVIY

SEQ ID NO: 4446 - protein, 9 aa, Homo Sapiens
VIYSVKTKQ

SEQ ID NO: 4447 - protein, 9 aa, Homo Sapiens
AVIKILHSK

SEQ ID NO: 4448 - protein, 9 aa, Homo Sapiens
MYYFLSMLS

SEQ ID NO: 4449 - protein, 9 aa, Homo Sapiens
TDLGLSIST

SEQ ID NO: 4450 - protein, 9 aa, Homo Sapiens
ISTLVTMLS

SEQ ID NO: 4451 - protein, 9 aa, Homo Sapiens
FWFNVREIS

SEQ ID NO: 4452 - protein, 9 aa, Homo Sapiens
NVREISFNA

SEQ ID NO: 4453 - protein, 9 aa, Homo Sapiens
SVLLAMAFD

SEQ ID NO: 4454 - protein, 9 aa, Homo Sapiens
AMAFDRFVA

SEQ ID NO: 4455 - protein, 9 aa, Homo Sapiens
AFDRFVAVS

SEQ ID NO: 4456 - protein, 9 aa, Homo Sapiens
FDRFVAVSN

SEQ ID NO: 4457 - protein, 9 aa, Homo Sapiens
ILTDSRIAQ

SEQ ID NO: 4458 - protein, 9 aa, Homo Sapiens
TDSRIAQIG

SEQ ID NO: 4459 - protein, 9 aa, Homo Sapiens
LLIRLSYCH

SEQ ID NO: 4460 - protein, 9 aa, Homo Sapiens
LHHSYCYHP

SEQ ID NO: 4461 - protein, 9 aa, Homo Sapiens
SCTDTRINS

SEQ ID NO: 4462 - protein, 9 aa, Homo Sapiens
INSAVGLTA

SEQ ID NO: 4463 - protein, 9 aa, Homo Sapiens
AVGLTAMFS

SEQ ID NO: 4464 - protein, 9 aa, Homo Sapiens
VGLTAMFST

SEQ ID NO: 4465 - protein, 9 aa, Homo Sapiens
VLIIRTVLS

SEQ ID NO: 4466 - protein, 9 aa, Homo Sapiens
SVASPEERK

SEQ ID NO: 4467 - protein, 9 aa, Homo Sapiens
CVSHIVAFA

SEQ ID NO: 4468 - protein, 9 aa, Homo Sapiens
HIVAFAIYY

SEQ ID NO: 4469 - protein, 9 aa, Homo Sapiens
YYIPLISLS

SEQ ID NO: 4470 - protein, 9 aa, Homo Sapiens
PLISLSIVH

SEQ ID NO: 4471 - protein, 9 aa, Homo Sapiens
IVHRFGKQA

SEQ ID NO: 4472 - protein, 9 aa, Homo Sapiens
PAYVHTMIA

SEQ ID NO: 4473 - protein, 9 aa, Homo Sapiens
AYVHTMIAN

SEQ ID NO: 4474 - protein, 9 aa, Homo Sapiens
IANTYLLIS

SEQ ID NO: 4475 - protein, 9 aa, Homo Sapiens
ANTYLLISP

SEQ ID NO: 4476 - protein, 9 aa, Homo Sapiens
NPVIYSVKT

SEQ ID NO: 4477 - protein, 9 aa, Homo Sapiens
PVIYSVKTK

SEQ ID NO: 4478 - protein, 9 aa, Homo Sapiens
VKTKQIRRA

SEQ ID NO: 4479 - protein, 9 aa, Homo Sapiens
IKILHSKET

SEQ ID NO: 4480 - protein, 9 aa, Homo Sapiens
LSATDLGLS

SEQ ID NO: 4481 - protein, 9 aa, Homo Sapiens
ATDLGLSIS

SEQ ID NO: 4482 - protein, 9 aa, Homo Sapiens
LVTMLSIFW

SEQ ID NO: 4483 - protein, 9 aa, Homo Sapiens
LSIFWFNVR

SEQ ID NO: 4484 - protein, 9 aa, Homo Sapiens
FNVREISFN

SEQ ID NO: 4485 - protein, 9 aa, Homo Sapiens
EISFNACLS

SEQ ID NO: 4486 - protein, 9 aa, Homo Sapiens
FIKFFTVME

SEQ ID NO: 4487 - protein, 9 aa, Homo Sapiens
FVAVSNPLR

SEQ ID NO: 4488 - protein, 9 aa, Homo Sapiens
AVSNPLRYA

SEQ ID NO: 4489 - protein, 9 aa, Homo Sapiens
QIGVASVIR

SEQ ID NO: 4490 - protein, 9 aa, Homo Sapiens
TPMVALLIR

SEQ ID NO: 4491 - protein, 9 aa, Homo Sapiens
SYCHSQVLH

SEQ ID NO: 4492 - protein, 9 aa, Homo Sapiens
SQVLHHSYC

SEQ ID NO: 4493 - protein, 9 aa, Homo Sapiens
HPDVMKLSC

SEQ ID NO: 4494 - protein, 9 aa, Homo Sapiens
PDVMKLSCT

SEQ ID NO: 4495 - protein, 9 aa, Homo Sapiens
LSCTDTRIN

SEQ ID NO: 4496 - protein, 9 aa, Homo Sapiens
IIRTVLSVA

SEQ ID NO: 4497 - protein, 9 aa, Homo Sapiens
VLSVASPEE

SEQ ID NO: 4498 - protein, 9 aa, Homo Sapiens
LSVASPEER

SEQ ID NO: 4499 - protein, 9 aa, Homo Sapiens
VASPEERKE

SEQ ID NO: 4500 - protein, 9 aa, Homo Sapiens
ASPEERKET

SEQ ID NO: 4501 - protein, 9 aa, Homo Sapiens
SHIVAFAIY

SEQ ID NO: 4502 - protein, 9 aa, Homo Sapiens
LISLSIVHR

SEQ ID NO: 4503 - protein, 9 aa, Homo Sapiens
LSIVHRFGK

SEQ ID NO: 4504 - protein, 9 aa, Homo Sapiens
SIVHRFGKQ

SEQ ID NO: 4505 - protein, 9 aa, Homo Sapiens
YVHTMIANT

SEQ ID NO: 4506 - protein, 9 aa, Homo Sapiens
PLMNPVIYS

SEQ ID NO: 4507 - protein, 9 aa, Homo Sapiens
MNPVIYSVK

SEQ ID NO: 4508 - protein, 9 aa, Homo Sapiens
YSVKTKQIR

SEQ ID NO: 4509 - protein, 9 aa, Homo Sapiens
SVKTKQIRR

SEQ ID NO: 4510 - protein, 9 aa, Homo Sapiens
REISFNACL

SEQ ID NO: 4511 - protein, 9 aa, Homo Sapiens
SHMFFIKFF

SEQ ID NO: 4512 - protein, 9 aa, Homo Sapiens
AQIGVASVI

SEQ ID NO: 4513 - protein, 9 aa, Homo Sapiens
SVIRGLLML

SEQ ID NO: 4514 - protein, 9 aa, Homo Sapiens
TRINSAVGL

SEQ ID NO: 4515 - protein, 9 aa, Homo Sapiens
TCVSHIVAF

SEQ ID NO: 4516 - protein, 9 aa, Homo Sapiens
TMIANTYLL

SEQ ID NO: 4517 - protein, 9 aa, Homo Sapiens
DLGLSISTL

SEQ ID NO: 4518 - protein, 9 aa, Homo Sapiens
VTMLSIFWF

SEQ ID NO: 4519 - protein, 9 aa, Homo Sapiens
MESSVLLAM

SEQ ID NO: 4520 - protein, 9 aa, Homo Sapiens
SSVLLAMAF

SEQ ID NO: 4521 - protein, 9 aa, Homo Sapiens
AMILTDSRI

SEQ ID NO: 4522 - protein, 9 aa, Homo Sapiens
LMLTPMVAL

SEQ ID NO: 4523 - protein, 9 aa, Homo Sapiens
MLTPMVALL

SEQ ID NO: 4524 - protein, 9 aa, Homo Sapiens
VALLIRLSY

SEQ ID NO: 4525 - protein, 9 aa, Homo Sapiens
CYHPDVMKL

SEQ ID NO: 4526 - protein, 9 aa, Homo Sapiens
GVDLLLILL

SEQ ID NO: 4527 - protein, 9 aa, Homo Sapiens
DLLLILLSY

SEQ ID NO: 4528 - protein, 9 aa, Homo Sapiens
LLILLSYVL

SEQ ID NO: 4529 - protein, 9 aa, Homo Sapiens
SHIVAFAIY

SEQ ID NO: 4530 - protein, 9 aa, Homo Sapiens
FAIYYIPLI

SEQ ID NO: 4531 - protein, 9 aa, Homo Sapiens
NTYLLISPL

SEQ ID NO: 4532 - protein, 9 aa, Homo Sapiens
SPLMNPVIY

SEQ ID NO: 4533 - protein, 9 aa, Homo Sapiens
IRRAVIKIL

SEQ ID NO: 4534 - protein, 9 aa, Homo Sapiens
SISTLVTML

SEQ ID NO: 4535 - protein, 9 aa, Homo Sapiens
NPLRYAMIL

SEQ ID NO: 4536 - protein, 9 aa, Homo Sapiens
LTDSRIAQI

SEQ ID NO: 4537 - protein, 9 aa, Homo Sapiens
GVASVIRGL

SEQ ID NO: 4538 - protein, 9 aa, Homo Sapiens
VASVIRGLL

SEQ ID NO: 4539 - protein, 9 aa, Homo Sapiens
STVGVDLLL

SEQ ID NO: 4540 - protein, 9 aa, Homo Sapiens
YVLIIRTVL

SEQ ID NO: 4541 - protein, 9 aa, Homo Sapiens
AFAIYYIPL

SEQ ID NO: 4542 - protein, 9 aa, Homo Sapiens
ISLSIVHRF

SEQ ID NO: 4543 - protein, 9 aa, Homo Sapiens
VHTMIANTY

SEQ ID NO: 4544 - protein, 9 aa, Homo Sapiens
LSMLSATDL

SEQ ID NO: 4545 - protein, 9 aa, Homo Sapiens
LSHMFFIKF

SEQ ID NO: 4546 - protein, 9 aa, Homo Sapiens
TVMESSVLL

SEQ ID NO: 4547 - protein, 9 aa, Homo Sapiens
VAVSNPLRY

SEQ ID NO: 4548 - protein, 9 aa, Homo Sapiens
SAVGLTAMF

SEQ ID NO: 4549 - protein, 9 aa, Homo Sapiens
MFSTVGVDL

SEQ ID NO: 4550 - protein, 9 aa, Homo Sapiens
VGVDLLLIL

SEQ ID NO: 4551 - protein, 9 aa, Homo Sapiens
SPEERKETF

SEQ ID NO: 4552 - protein, 9 aa, Homo Sapiens
EERKETFST

SEQ ID NO: 4553 - protein, 9 aa, Homo Sapiens
KETFSTCVS

SEQ ID NO: 4554 - protein, 9 aa, Homo Sapiens
RFGKQAPAY

SEQ ID NO: 4555 - protein, 9 aa, Homo Sapiens
IYSVKTKQI

SEQ ID NO: 4556 - protein, 9 aa, Homo Sapiens
MLSATDLGL

SEQ ID NO: 4557 - protein, 9 aa, Homo Sapiens
TLVTMLSIF

SEQ ID NO: 4558 - protein, 9 aa, Homo Sapiens
WFNVREISF

SEQ ID NO: 4559 - protein, 9 aa, Homo Sapiens
NACLSHMFF

SEQ ID NO: 4560 - protein, 9 aa, Homo Sapiens
ACLSHMFFI

SEQ ID NO: 4561 - protein, 9 aa, Homo Sapiens
SNPLRYAMI

SEQ ID NO: 4562 - protein, 9 aa, Homo Sapiens
LTPMVALLI

SEQ ID NO: 4563 - protein, 9 aa, Homo Sapiens
PMVALLIRL

SEQ ID NO: 4564 - protein, 9 aa, Homo Sapiens
FSTVGVDLL

SEQ ID NO: 4565 - protein, 9 aa, Homo Sapiens
LILLSYVLI

SEQ ID NO: 4566 - protein, 9 aa, Homo Sapiens
HIVAFAIYY

SEQ ID NO: 4567 - protein, 9 aa, Homo Sapiens
IYYIPLISL

SEQ ID NO: 4568 - protein, 9 aa, Homo Sapiens
YIPLISLSI

SEQ ID NO: 4569 - protein, 9 aa, Homo Sapiens
QIRRAVIKI

SEQ ID NO: 4570 - protein, 9 aa, Homo Sapiens
SATDLGLSI

SEQ ID NO: 4571 - protein, 9 aa, Homo Sapiens
STLVTMLSI

SEQ ID NO: 4572 - protein, 9 aa, Homo Sapiens
LVTMLSIFW

SEQ ID NO: 4573 - protein, 9 aa, Homo Sapiens
IFWFNVREI

SEQ ID NO: 4574 - protein, 9 aa, Homo Sapiens
FNACLSHMF

SEQ ID NO: 4575 - protein, 9 aa, Homo Sapiens
FTVMESSVL

SEQ ID NO: 4576 - protein, 9 aa, Homo Sapiens
LLAMAFDRF

SEQ ID NO: 4577 - protein, 9 aa, Homo Sapiens
RFVAVSNPL

SEQ ID NO: 4578 - protein, 9 aa, Homo Sapiens
LSYCHSQVL

SEQ ID NO: 4579 - protein, 9 aa, Homo Sapiens
HSQVLHHSY

SEQ ID NO: 4580 - protein, 9 aa, Homo Sapiens
QVLHHSYCY

SEQ ID NO: 4581 - protein, 9 aa, Homo Sapiens
TVGVDLLLI

SEQ ID NO: 4582 - protein, 9 aa, Homo Sapiens
ILLSYVLII

SEQ ID NO: 4583 - protein, 9 aa, Homo Sapiens
PEERKETFS

SEQ ID NO: 4584 - protein, 9 aa, Homo Sapiens
TFSTCVSHI

SEQ ID NO: 4585 - protein, 9 aa, Homo Sapiens
VSHIVAFAI

SEQ ID NO: 4586 - protein, 9 aa, Homo Sapiens
IVAFAIYYI

SEQ ID NO: 4587 - protein, 9 aa, Homo Sapiens
APAYVHTMI

SEQ ID NO: 4588 - protein, 9 aa, Homo Sapiens
HTMIANTYL

SEQ ID NO: 4589 - protein, 9 aa, Homo Sapiens
MIANTYLLI

SEQ ID NO: 4590 - protein, 9 aa, Homo Sapiens
ISPLMNPVI

SEQ ID NO: 4591 - protein, 9 aa, Homo Sapiens
TKQIRRAVI

SEQ ID NO: 4592 - protein, 9 aa, Homo Sapiens
KLSCTDTRI

SEQ ID NO: 4593 - protein, 9 aa, Homo Sapiens
YYIPLISLS

SEQ ID NO: 4594 - protein, 9 aa, Homo Sapiens
AVIKILHSK

SEQ ID NO: 4595 - protein, 9 aa, Homo Sapiens
MAFDRFVAV

SEQ ID NO: 4596 - protein, 9 aa, Homo Sapiens
SRIAQIGVA

SEQ ID NO: 4597 - protein, 9 aa, Homo Sapiens
SYVLIIRTV

SEQ ID NO: 4598 - protein, 9 aa, Homo Sapiens
KQIRRAVIK

SEQ ID NO: 4599 - protein, 9 aa, Homo Sapiens
AFDRFVAVS

SEQ ID NO: 4600 - protein, 9 aa, Homo Sapiens
AVSNPLRYA

SEQ ID NO: 4601 - protein, 9 aa, Homo Sapiens
CTDTRINSA

SEQ ID NO: 4602 - protein, 9 aa, Homo Sapiens
AMFSTVGVD

SEQ ID NO: 4603 - protein, 9 aa, Homo Sapiens
VDLLLILLS

SEQ ID NO: 4604 - protein, 9 aa, Homo Sapiens
VLIIRTVLS

SEQ ID NO: 4605 - protein, 9 aa, Homo Sapiens
ASPEERKET

SEQ ID NO: 4606 - protein, 9 aa, Homo Sapiens
PVIYSVKTK

SEQ ID NO: 4607 - protein, 9 aa, Homo Sapiens
ATDLGLSIS

SEQ ID NO: 4608 - protein, 9 aa, Homo Sapiens
LSISTLVTM

SEQ ID NO: 4609 - protein, 9 aa, Homo Sapiens
LSIFWFNVR

SEQ ID NO: 4610 - protein, 9 aa, Homo Sapiens
EISFNACLS

SEQ ID NO: 4611 - protein, 9 aa, Homo Sapiens
VSNPLRYAM

SEQ ID NO: 4612 - protein, 9 aa, Homo Sapiens
ASVIRGLLM

SEQ ID NO: 4613 - protein, 9 aa, Homo Sapiens
MVALLIRLS

SEQ ID NO: 4614 - protein, 9 aa, Homo Sapiens
ALLIRLSYC

SEQ ID NO: 4615 - protein, 9 aa, Homo Sapiens
LIIRTVLSV

SEQ ID NO: 4616 - protein, 9 aa, Homo Sapiens
VASPEERKE

SEQ ID NO: 4617 - protein, 9 aa, Homo Sapiens
AIYYIPLIS

SEQ ID NO: 4618 - protein, 9 aa, Homo Sapiens
LISLSIVHR

SEQ ID NO: 4619 - protein, 9 aa, Homo Sapiens
AYVHTMIAN

SEQ ID NO: 4620 - protein, 9 aa, Homo Sapiens
LMNPVIYSV

SEQ ID NO: 4621 - protein, 9 aa, Homo Sapiens
KTKQIRRAV

SEQ ID NO: 4622 - protein, 9 aa, Homo Sapiens
IKILHSKET

SEQ ID NO: 4623 - protein, 9 aa, Homo Sapiens
FFIKFFTVM

SEQ ID NO: 4624 - protein, 9 aa, Homo Sapiens
AMAFDRFVA

SEQ ID NO: 4625 - protein, 9 aa, Homo Sapiens
LRYAMILTD

SEQ ID NO: 4626 - protein, 9 aa, Homo Sapiens
ILTDSRIAQ

SEQ ID NO: 4627 - protein, 9 aa, Homo Sapiens
YHPDVMKLS

SEQ ID NO: 4628 - protein, 9 aa, Homo Sapiens
AVGLTAMFS

SEQ ID NO: 4629 - protein, 9 aa, Homo Sapiens
ETFSTCVSH

SEQ ID NO: 4630 - protein, 9 aa, Homo Sapiens
PLISLSIVH

SEQ ID NO: 4631 - protein, 9 aa, Homo Sapiens
KQAPAYVHT

SEQ ID NO: 4632 - protein, 9 aa, Homo Sapiens
ANTYLLISP

SEQ ID NO: 4633 - protein, 9 aa, Homo Sapiens
LISPLMNPV

SEQ ID NO: 4634 - protein, 9 aa, Homo Sapiens
YYFLSMLSA

SEQ ID NO: 4635 - protein, 9 aa, Homo Sapiens
YFLSMLSAT

SEQ ID NO: 4636 - protein, 9 aa, Homo Sapiens
SMLSATDLG

SEQ ID NO: 4637 - protein, 9 aa, Homo Sapiens
GLSISTLVT

SEQ ID NO: 4638 - protein, 9 aa, Homo Sapiens
SIFWFNVRE

SEQ ID NO: 4639 - protein, 9 aa, Homo Sapiens
FWFNVREIS

SEQ ID NO: 4640 - protein, 9 aa, Homo Sapiens
FNVREISFN

SEQ ID NO: 4641 - protein, 9 aa, Homo Sapiens
VREISFNAC

SEQ ID NO: 4642 - protein, 9 aa, Homo Sapiens
ISFNACLSH

SEQ ID NO: 4643 - protein, 9 aa, Homo Sapiens
MFFIKFFTV

SEQ ID NO: 4644 - protein, 9 aa, Homo Sapiens
KFFTVMESS

SEQ ID NO: 4645 - protein, 9 aa, Homo Sapiens
ESSVLLAMA

SEQ ID NO: 4646 - protein, 9 aa, Homo Sapiens
TDSRIAQIG

SEQ ID NO: 4647 - protein, 9 aa, Homo Sapiens
RIAQIGVAS

SEQ ID NO: 4648 - protein, 9 aa, Homo Sapiens
LLMLTPMVA

SEQ ID NO: 4649 - protein, 9 aa, Homo Sapiens
LLIRLSYCH

SEQ ID NO: 4650 - protein, 9 aa, Homo Sapiens
SCTDTRINS

SEQ ID NO: 4651 - protein, 9 aa, Homo Sapiens
TDTRINSAV

SEQ ID NO: 4652 - protein, 9 aa, Homo Sapiens
NSAVGLTAM

SEQ ID NO: 4653 - protein, 9 aa, Homo Sapiens
LSYVLIIRT

SEQ ID NO: 4654 - protein, 9 aa, Homo Sapiens
ERKETFSTC

SEQ ID NO: 4655 - protein, 9 aa, Homo Sapiens
LSIVHRFGK

SEQ ID NO: 4656 - protein, 9 aa, Homo Sapiens
SIVHRFGKQ

SEQ ID NO: 4657 - protein, 9 aa, Homo Sapiens
IVHRFGKQA

SEQ ID NO: 4658 - protein, 9 aa, Homo Sapiens
QAPAYVHTM

SEQ ID NO: 4659 - protein, 9 aa, Homo Sapiens
YVHTMIANT

SEQ ID NO: 4660 - protein, 9 aa, Homo Sapiens
TYLLISPLM

SEQ ID NO: 4661 - protein, 9 aa, Homo Sapiens
LLISPLMNP

SEQ ID NO: 4662 - protein, 9 aa, Homo Sapiens
PLMNPVIYS

SEQ ID NO: 4663 - protein, 9 aa, Homo Sapiens
VKTKQIRRA

SEQ ID NO: 4664 - protein, 9 aa, Homo Sapiens
RAVIKILHS

SEQ ID NO: 4665 - protein, 9 aa, Homo Sapiens
LSATDLGLS

SEQ ID NO: 4666 - protein, 9 aa, Homo Sapiens
TDLGLSIST

SEQ ID NO: 4667 - protein, 9 aa, Homo Sapiens
LGLSISTLV

SEQ ID NO: 4668 - protein, 9 aa, Homo Sapiens
ISTLVTMLS

SEQ ID NO: 4669 - protein, 9 aa, Homo Sapiens
TMLSIFWFN

SEQ ID NO: 4670 - protein, 9 aa, Homo Sapiens
HMFFIKFFT

SEQ ID NO: 4671 - protein, 9 aa, Homo Sapiens
IKFFTVMES

SEQ ID NO: 4672 - protein, 9 aa, Homo Sapiens
VMESSVLLA

SEQ ID NO: 4673 - protein, 9 aa, Homo Sapiens
SVLLAMAFD

SEQ ID NO: 4674 - protein, 9 aa, Homo Sapiens
DRFVAVSNP

SEQ ID NO: 4675 - protein, 9 aa, Homo Sapiens
MILTDSRIA

SEQ ID NO: 4676 - protein, 9 aa, Homo Sapiens
VIRGLLMLT

SEQ ID NO: 4677 - protein, 9 aa, Homo Sapiens
IRGLLMLTP

SEQ ID NO: 4678 - protein, 9 aa, Homo Sapiens
RGLLMLTPM

SEQ ID NO: 4679 - protein, 9 aa, Homo Sapiens
TPMVALLIR

SEQ ID NO: 4680 - protein, 9 aa, Homo Sapiens
SYCHSQVLH

SEQ ID NO: 4681 - protein, 9 aa, Homo Sapiens
CHSQVLHHS

SEQ ID NO: 4682 - protein, 9 aa, Homo Sapiens
SYCYHPDVM

SEQ ID NO: 4683 - protein, 9 aa, Homo Sapiens
MKLSCTDTR

SEQ ID NO: 4684 - protein, 9 aa, Homo Sapiens
LSCTDTRIN

SEQ ID NO: 4685 - protein, 9 aa, Homo Sapiens
INSAVGLTA

SEQ ID NO: 4686 - protein, 9 aa, Homo Sapiens
TAMFSTVGV

SEQ ID NO: 4687 - protein, 9 aa, Homo Sapiens
LLSYVLIIR

SEQ ID NO: 4688 - protein, 9 aa, Homo Sapiens
IIRTVLSVA

SEQ ID NO: 4689 - protein, 9 aa, Homo Sapiens
IRTVLSVAS

SEQ ID NO: 4690 - protein, 9 aa, Homo Sapiens
STCVSHIVA

SEQ ID NO: 4691 - protein, 9 aa, Homo Sapiens
CVSHIVAFA

SEQ ID NO: 4692 - protein, 9 aa, Homo Sapiens
VAFAIYYIP

SEQ ID NO: 4693 - protein, 9 aa, Homo Sapiens
SLSIVHRFG

SEQ ID NO: 4694 - protein, 9 aa, Homo Sapiens
HRFGKQAPA

SEQ ID NO: 4695 - protein, 9 aa, Homo Sapiens
IANTYLLIS

SEQ ID NO: 4696 - protein, 9 aa, Homo Sapiens
YLLISPLMN

SEQ ID NO: 4697 - protein, 9 aa, Homo Sapiens
MNPVIYSVK

SEQ ID NO: 4698 - protein, 9 aa, Homo Sapiens
NPVIYSVKT

SEQ ID NO: 4699 - protein, 9 aa, Homo Sapiens
SVKTKQIRR

SEQ ID NO: 4700 - protein, 9 aa, Homo Sapiens
RRAVIKILH

SEQ ID NO: 4701 - protein, 9 aa, Homo Sapiens
FLSMLSATD

SEQ ID NO: 4702 - protein, 9 aa, Homo Sapiens
NVREISFNA

SEQ ID NO: 4703 - protein, 9 aa, Homo Sapiens
SFNACLSHM

SEQ ID NO: 4704 - protein, 9 aa, Homo Sapiens
CLSHMFFIK

SEQ ID NO: 4705 - protein, 9 aa, Homo Sapiens
FIKFFTVME

SEQ ID NO: 4706 - protein, 9 aa, Homo Sapiens
VLLAMAFDR

SEQ ID NO: 4707 - protein, 9 aa, Homo Sapiens
LAMAFDRFV

SEQ ID NO: 4708 - protein, 9 aa, Homo Sapiens
FDRFVAVSN

SEQ ID NO: 4709 - protein, 9 aa, Homo Sapiens
PLRYAMILT

SEQ ID NO: 4710 - protein, 9 aa, Homo Sapiens
RYAMILTDS

SEQ ID NO: 4711 - protein, 9 aa, Homo Sapiens
YAMILTDSR

SEQ ID NO: 4712 - protein, 9 aa, Homo Sapiens
IGVASVIRG

SEQ ID NO: 4713 - protein, 9 aa, Homo Sapiens
GLLMLTPMV

SEQ ID NO: 4714 - protein, 9 aa, Homo Sapiens
IRLSYCHSQ

SEQ ID NO: 4715 - protein, 9 aa, Homo Sapiens
RLSYCHSQV

SEQ ID NO: 4716 - protein, 9 aa, Homo Sapiens
YCHSQVLHH

SEQ ID NO: 4717 - protein, 9 aa, Homo Sapiens
SQVLHHSYC

SEQ ID NO: 4718 - protein, 9 aa, Homo Sapiens
HHSYCYHPD

SEQ ID NO: 4719 - protein, 9 aa, Homo Sapiens
HPDVMKLSC

SEQ ID NO: 4720 - protein, 9 aa, Homo Sapiens
DVMKLSCTD

SEQ ID NO: 4721 - protein, 9 aa, Homo Sapiens
DTRINSAVG

SEQ ID NO: 4722 - protein, 9 aa, Homo Sapiens
RINSAVGLT

SEQ ID NO: 4723 - protein, 9 aa, Homo Sapiens
VGLTAMFST

SEQ ID NO: 4724 - protein, 9 aa, Homo Sapiens
GLTAMFSTV

SEQ ID NO: 4725 - protein, 9 aa, Homo Sapiens
LLLILLSYV

SEQ ID NO: 4726 - protein, 9 aa, Homo Sapiens
RTVLSVASP

SEQ ID NO: 4727 - protein, 9 aa, Homo Sapiens
TVLSVASPE

SEQ ID NO: 4728 - protein, 9 aa, Homo Sapiens
IPLISLSIV

SEQ ID NO: 4729 - protein, 9 aa, Homo Sapiens
VHRFGKQAP

SEQ ID NO: 4730 - protein, 9 aa, Homo Sapiens
GKQAPAYVH

SEQ ID NO: 4731 - protein, 9 aa, Homo Sapiens
MYYFLSMLS

SEQ ID NO: 4732 - protein, 9 aa, Homo Sapiens
MLSIFWFNV

SEQ ID NO: 4733 - protein, 9 aa, Homo Sapiens
FVAVSNPLR

SEQ ID NO: 4734 - protein, 9 aa, Homo Sapiens
DSRIAQIGV

SEQ ID NO: 4735 - protein, 9 aa, Homo Sapiens
IAQIGVASV

SEQ ID NO: 4736 - protein, 9 aa, Homo Sapiens
QIGVASVIR

SEQ ID NO: 4737 - protein, 9 aa, Homo Sapiens
LIRLSYCHS

SEQ ID NO: 4738 - protein, 9 aa, Homo Sapiens
YCYHPDVMK

SEQ ID NO: 4739 - protein, 9 aa, Homo Sapiens
PDVMKLSCT

SEQ ID NO: 4740 - protein, 9 aa, Homo Sapiens
VMKLSCTDT

SEQ ID NO: 4741 - protein, 9 aa, Homo Sapiens
LTAMFSTVG

SEQ ID NO: 4742 - protein, 9 aa, Homo Sapiens
VLSVASPEE

SEQ ID NO: 4743 - protein, 9 aa, Homo Sapiens
LSVASPEER

SEQ ID NO: 4744 - protein, 9 aa, Homo Sapiens
SVASPEERK

SEQ ID NO: 4745 - protein, 9 aa, Homo Sapiens
RKETFSTCV

SEQ ID NO: 4746 - protein, 9 aa, Homo Sapiens
FSTCVSHIV

SEQ ID NO: 4747 - protein, 9 aa, Homo Sapiens
FGKQAPAYV

SEQ ID NO: 4748 - protein, 9 aa, Homo Sapiens
PAYVHTMIA

SEQ ID NO: 4749 - protein, 9 aa, Homo Sapiens
VIYSVKTKQ

SEQ ID NO: 4750 - protein, 9 aa, Homo Sapiens
VIKILHSKE

SEQ ID NO: 4751 - protein, 9 aa, Homo Sapiens
IPLISLSIV

SEQ ID NO: 4752 - protein, 9 aa, Homo Sapiens
MAFDRFVAV

SEQ ID NO: 4753 - protein, 9 aa, Homo Sapiens
FAIYYIPLI

SEQ ID NO: 4754 - protein, 9 aa, Homo Sapiens
APAYVHTMI

SEQ ID NO: 4755 - protein, 9 aa, Homo Sapiens
SATDLGLSI

SEQ ID NO: 4756 - protein, 9 aa, Homo Sapiens
LAMAFDRFV

SEQ ID NO: 4757 - protein, 9 aa, Homo Sapiens
IAQIGVASV

SEQ ID NO: 4758 - protein, 9 aa, Homo Sapiens
NPLRYAMIL

SEQ ID NO: 4759 - protein, 9 aa, Homo Sapiens
TAMFSTVGV

SEQ ID NO: 4760 - protein, 9 aa, Homo Sapiens
LGLSISTLV

SEQ ID NO: 4761 - protein, 9 aa, Homo Sapiens
ILLSYVLII

SEQ ID NO: 4762 - protein, 9 aa, Homo Sapiens
ISPLMNPVI

SEQ ID NO: 4763 - protein, 9 aa, Homo Sapiens
AQIGVASVI

SEQ ID NO: 4764 - protein, 9 aa, Homo Sapiens
VASVIRGLL

SEQ ID NO: 4765 - protein, 9 aa, Homo Sapiens
LTPMVALLI

SEQ ID NO: 4766 - protein, 9 aa, Homo Sapiens
QAPAYVHTM

SEQ ID NO: 4767 - protein, 9 aa, Homo Sapiens
IFWFNVREI

SEQ ID NO: 4768 - protein, 9 aa, Homo Sapiens
VGVDLLLIL

SEQ ID NO: 4769 - protein, 9 aa, Homo Sapiens
LILLSYVLI

SEQ ID NO: 4770 - protein, 9 aa, Homo Sapiens
FGKQAPAYV

SEQ ID NO: 4771 - protein, 9 aa, Homo Sapiens
IANTYLLIS

SEQ ID NO: 4772 - protein, 9 aa, Homo Sapiens
LSYCHSQVL

SEQ ID NO: 4773 - protein, 9 aa, Homo Sapiens
TFSTCVSHI

SEQ ID NO: 4774 - protein, 9 aa, Homo Sapiens
NPVIYSVKT

SEQ ID NO: 4775 - protein, 9 aa, Homo Sapiens
QIRRAVIKI

SEQ ID NO: 4776 - protein, 9 aa, Homo Sapiens
DLGLSISTL

SEQ ID NO: 4777 - protein, 9 aa, Homo Sapiens
STLVTMLSI

SEQ ID NO: 4778 - protein, 9 aa, Homo Sapiens
MFFIKFFTV

SEQ ID NO: 4779 - protein, 9 aa, Homo Sapiens
VAVSNPLRY

SEQ ID NO: 4780 - protein, 9 aa, Homo Sapiens
IGVASVIRG

SEQ ID NO: 4781 - protein, 9 aa, Homo Sapiens
VALLIRLSY

SEQ ID NO: 4782 - protein, 9 aa, Homo Sapiens
YVLIIRTVL

SEQ ID NO: 4783 - protein, 9 aa, Homo Sapiens
LIIRTVLSV

SEQ ID NO: 4784 - protein, 9 aa, Homo Sapiens
VASPEERKE

SEQ ID NO: 4785 - protein, 9 aa, Homo Sapiens
SPEERKETF

SEQ ID NO: 4786 - protein, 9 aa, Homo Sapiens
VSHIVAFAI

SEQ ID NO: 4787 - protein, 9 aa, Homo Sapiens
IYYIPLISL

SEQ ID NO: 4788 - protein, 9 aa, Homo Sapiens
YIPLISLSI

SEQ ID NO: 4789 - protein, 9 aa, Homo Sapiens
PAYVHTMIA

SEQ ID NO: 4790 - protein, 9 aa, Homo Sapiens
SPLMNPVIY

SEQ ID NO: 4791 - protein, 9 aa, Homo Sapiens
IYSVKTKQI

SEQ ID NO: 4792 - protein, 9 aa, Homo Sapiens
TKQIRRAVI

SEQ ID NO: 4793 - protein, 9 aa, Homo Sapiens
RAVIKILHS

SEQ ID NO: 4794 - protein, 9 aa, Homo Sapiens
LTDSRIAQI

SEQ ID NO: 4795 - protein, 9 aa, Homo Sapiens
DSRIAQIGV

SEQ ID NO: 4796 - protein, 9 aa, Homo Sapiens
TPMVALLIR

SEQ ID NO: 4797 - protein, 9 aa, Homo Sapiens
HSYCYHPDV

SEQ ID NO: 4798 - protein, 9 aa, Homo Sapiens
KLSCTDTRI

SEQ ID NO: 4799 - protein, 9 aa, Homo Sapiens
GLTAMFSTV

SEQ ID NO: 4800 - protein, 9 aa, Homo Sapiens
TVGVDLLLI

SEQ ID NO: 4801 - protein, 9 aa, Homo Sapiens
LLLILLSYV

SEQ ID NO: 4802 - protein, 9 aa, Homo Sapiens
IVAFAIYYI

SEQ ID NO: 4803 - protein, 9 aa, Homo Sapiens
VAFAIYYIP

SEQ ID NO: 4804 - protein, 9 aa, Homo Sapiens
MIANTYLLI

SEQ ID NO: 4805 - protein, 9 aa, Homo Sapiens
LMNPVIYSV

SEQ ID NO: 4806 - protein, 9 aa, Homo Sapiens
IRRAVIKIL

SEQ ID NO: 4807 - protein, 9 aa, Homo Sapiens
NACLSHMFF

SEQ ID NO: 4808 - protein, 9 aa, Homo Sapiens
ACLSHMFFI

SEQ ID NO: 4809 - protein, 9 aa, Homo Sapiens
LRYAMILTD

SEQ ID NO: 4810 - protein, 9 aa, Homo Sapiens
YAMILTDSR

SEQ ID NO: 4811 - protein, 9 aa, Homo Sapiens
AMILTDSRI

SEQ ID NO: 4812 - protein, 9 aa, Homo Sapiens
LMLTPMVAL

SEQ ID NO: 4813 - protein, 9 aa, Homo Sapiens
HPDVMKLSC

SEQ ID NO: 4814 - protein, 9 aa, Homo Sapiens
SYVLIIRTV

SEQ ID NO: 4815 - protein, 9 aa, Homo Sapiens
NTYLLISPL

SEQ ID NO: 4816 - protein, 9 aa, Homo Sapiens
LSMLSATDL

SEQ ID NO: 4817 - protein, 9 aa, Homo Sapiens
TVMESSVLL

SEQ ID NO: 4818 - protein, 9 aa, Homo Sapiens
SNPLRYAMI

SEQ ID NO: 4819 - protein, 9 aa, Homo Sapiens
RGLLMLTPM

SEQ ID NO: 4820 - protein, 9 aa, Homo Sapiens
SAVGLTAMF

SEQ ID NO: 4821 - protein, 9 aa, Homo Sapiens
MFSTVGVDL

SEQ ID NO: 4822 - protein, 9 aa, Homo Sapiens
LLILLSYVL

SEQ ID NO: 4823 - protein, 9 aa, Homo Sapiens
FSTCVSHIV

SEQ ID NO: 4824 - protein, 9 aa, Homo Sapiens
LISPLMNPV

SEQ ID NO: 4825 - protein, 9 aa, Homo Sapiens
MLSATDLGL

SEQ ID NO: 4826 - protein, 9 aa, Homo Sapiens
SISTLVTML

SEQ ID NO: 4827 - protein, 9 aa, Homo Sapiens
FFTVMESSV

SEQ ID NO: 4828 - protein, 9 aa, Homo Sapiens
FTVMESSVL

SEQ ID NO: 4829 - protein, 9 aa, Homo Sapiens
RFVAVSNPL

SEQ ID NO: 4830 - protein, 9 aa, Homo Sapiens
GVASVIRGL

SEQ ID NO: 4831 - protein, 9 aa, Homo Sapiens
GLLMLTPMV

SEQ ID NO: 4832 - protein, 9 aa, Homo Sapiens
MLTPMVALL

SEQ ID NO: 4833 - protein, 9 aa, Homo Sapiens
PMVALLIRL

SEQ ID NO: 4834 - protein, 9 aa, Homo Sapiens
CYHPDVMKL

SEQ ID NO: 4835 - protein, 9 aa, Homo Sapiens
TDTRINSAV

SEQ ID NO: 4836 - protein, 9 aa, Homo Sapiens
TRINSAVGL

SEQ ID NO: 4837 - protein, 9 aa, Homo Sapiens
VGLTAMFST

SEQ ID NO: 4838 - protein, 9 aa, Homo Sapiens
STVGVDLLL

SEQ ID NO: 4839 - protein, 9 aa, Homo Sapiens
RKETFSTCV

SEQ ID NO: 4840 - protein, 9 aa, Homo Sapiens
VIYSVKTKQ

SEQ ID NO: 4841 - protein, 9 aa, Homo Sapiens
MLSIFWFNV

SEQ ID NO: 4842 - protein, 9 aa, Homo Sapiens
FSTVGVDLL

SEQ ID NO: 4843 - protein, 9 aa, Homo Sapiens
LSYVLIIRT

SEQ ID NO: 4844 - protein, 9 aa, Homo Sapiens
IIRTVLSVA

SEQ ID NO: 4845 - protein, 9 aa, Homo Sapiens
KTKQIRRAV

SEQ ID NO: 4846 - protein, 9 aa, Homo Sapiens
SVIRGLLML

SEQ ID NO: 4847 - protein, 9 aa, Homo Sapiens
RLSYCHSQV

SEQ ID NO: 4848 - protein, 9 aa, Homo Sapiens
INSAVGLTA

SEQ ID NO: 4849 - protein, 9 aa, Homo Sapiens
GVDLLLILL

SEQ ID NO: 4850 - protein, 9 aa, Homo Sapiens
DLLLILLSY

SEQ ID NO: 4851 - protein, 9 aa, Homo Sapiens
AFAIYYIPL

SEQ ID NO: 4852 - protein, 9 aa, Homo Sapiens
HTMIANTYL

SEQ ID NO: 4853 - protein, 9 aa, Homo Sapiens
TMIANTYLL

SEQ ID NO: 4854 - protein, 9 aa, Homo Sapiens
LSISTLVTM

SEQ ID NO: 4855 - protein, 9 aa, Homo Sapiens
LSIFWFNVR

SEQ ID NO: 4856 - protein, 9 aa, Homo Sapiens
REISFNACL

SEQ ID NO: 4857 - protein, 9 aa, Homo Sapiens
FFIKFFTVM

SEQ ID NO: 4858 - protein, 9 aa, Homo Sapiens
DRFVAVSNP

SEQ ID NO: 4859 - protein, 9 aa, Homo Sapiens
LLMLTPMVA

SEQ ID NO: 4860 - protein, 9 aa, Homo Sapiens
YCYHPDVMK

SEQ ID NO: 4861 - protein, 9 aa, Homo Sapiens
YHPDVMKLS

SEQ ID NO: 4862 - protein, 9 aa, Homo Sapiens
DVMKLSCTD

SEQ ID NO: 4863 - protein, 9 aa, Homo Sapiens
DTRINSAVG

SEQ ID NO: 4864 - protein, 9 aa, Homo Sapiens
AMFSTVGVD

SEQ ID NO: 4865 - protein, 9 aa, Homo Sapiens
ISLSIVHRF

SEQ ID NO: 4866 - protein, 9 aa, Homo Sapiens
YLLISPLMN

SEQ ID NO: 4867 - protein, 9 aa, Homo Sapiens
YFLSMLSAT

SEQ ID NO: 4868 - protein, 9 aa, Homo Sapiens
LSHMFFIKF

SEQ ID NO: 4869 - protein, 9 aa, Homo Sapiens
IKFFTVMES

SEQ ID NO: 4870 - protein, 9 aa, Homo Sapiens
VLLAMAFDR

SEQ ID NO: 4871 - protein, 9 aa, Homo Sapiens
YCHSQVLHH

SEQ ID NO: 4872 - protein, 9 aa, Homo Sapiens
LTAMFSTVG

SEQ ID NO: 4873 - protein, 9 aa, Homo Sapiens
LLSYVLIIR

SEQ ID NO: 4874 - protein, 9 aa, Homo Sapiens
TVLSVASPE

SEQ ID NO: 4875 - protein, 9 aa, Homo Sapiens
ERKETFSTC

SEQ ID NO: 4876 - protein, 9 aa, Homo Sapiens
AIYYIPLIS

SEQ ID NO: 4877 - protein, 9 aa, Homo Sapiens
LISLSIVHR

SEQ ID NO: 4878 - protein, 9 aa, Homo Sapiens
PVIYSVKTK

SEQ ID NO: 4879 - protein, 9 aa, Homo Sapiens
MYYFLSMLS

SEQ ID NO: 4880 - protein, 9 aa, Homo Sapiens
YYFLSMLSA

SEQ ID NO: 4881 - protein, 9 aa, Homo Sapiens
TDLGLSIST

SEQ ID NO: 4882 - protein, 9 aa, Homo Sapiens
GLSISTLVT

SEQ ID NO: 4883 - protein, 9 aa, Homo Sapiens
VMESSVLLA

SEQ ID NO: 4884 - protein, 9 aa, Homo Sapiens
MESSVLLAM

SEQ ID NO: 4885 - protein, 9 aa, Homo Sapiens
AFDRFVAVS

SEQ ID NO: 4886 - protein, 9 aa, Homo Sapiens
FDRFVAVSN

SEQ ID NO: 4887 - protein, 9 aa, Homo Sapiens
MILTDSRIA

SEQ ID NO: 4888 - protein, 9 aa, Homo Sapiens
ILTDSRIAQ

SEQ ID NO: 4889 - protein, 9 aa, Homo Sapiens
SRIAQIGVA

SEQ ID NO: 4890 - protein, 9 aa, Homo Sapiens
IRGLLMLTP

SEQ ID NO: 4891 - protein, 9 aa, Homo Sapiens
IRLSYCHSQ

SEQ ID NO: 4892 - protein, 9 aa, Homo Sapiens
MKLSCTDTR

SEQ ID NO: 4893 - protein, 9 aa, Homo Sapiens
VDLLLILLS

SEQ ID NO: 4894 - protein, 9 aa, Homo Sapiens
LSVASPEER

SEQ ID NO: 4895 - protein, 9 aa, Homo Sapiens
STCVSHIVA

SEQ ID NO: 4896 - protein, 9 aa, Homo Sapiens
GKQAPAYVH

SEQ ID NO: 4897 - protein, 9 aa, Homo Sapiens
YVHTMIANT

SEQ ID NO: 4898 - protein, 9 aa, Homo Sapiens
VHTMIANTY

SEQ ID NO: 4899 - protein, 9 aa, Homo Sapiens
MNPVIYSVK

SEQ ID NO: 4900 - protein, 9 aa, Homo Sapiens
VKTKQIRRA

SEQ ID NO: 4901 - protein, 9 aa, Homo Sapiens
LSATDLGLS

SEQ ID NO: 4902 - protein, 9 aa, Homo Sapiens
ISTLVTMLS

SEQ ID NO: 4903 - protein, 9 aa, Homo Sapiens
TLVTMLSIF

SEQ ID NO: 4904 - protein, 9 aa, Homo Sapiens
TMLSIFWFN

SEQ ID NO: 4905 - protein, 9 aa, Homo Sapiens
SIFWFNVRE

SEQ ID NO: 4906 - protein, 9 aa, Homo Sapiens
FWFNVREIS

SEQ ID NO: 4907 - protein, 9 aa, Homo Sapiens
VREISFNAC

SEQ ID NO: 4908 - protein, 9 aa, Homo Sapiens
ISFNACLSH

SEQ ID NO: 4909 - protein, 9 aa, Homo Sapiens
KFFTVMESS

SEQ ID NO: 4910 - protein, 9 aa, Homo Sapiens
LLAMAFDRF

SEQ ID NO: 4911 - protein, 9 aa, Homo Sapiens
LIRLSYCHS

SEQ ID NO: 4912 - protein, 9 aa, Homo Sapiens
CHSQVLHHS

SEQ ID NO: 4913 - protein, 9 aa, Homo Sapiens
LHHSYCYHP

SEQ ID NO: 4914 - protein, 9 aa, Homo Sapiens
SYCYHPDVM

SEQ ID NO: 4915 - protein, 9 aa, Homo Sapiens
LSCTDTRIN

SEQ ID NO: 4916 - protein, 9 aa, Homo Sapiens
ASPEERKET

SEQ ID NO: 4917 - protein, 9 aa, Homo Sapiens
KETFSTCVS

SEQ ID NO: 4918 - protein, 9 aa, Homo Sapiens
PLISLSIVH

SEQ ID NO: 4919 - protein, 9 aa, Homo Sapiens
YSVKTKQIR

SEQ ID NO: 4920 - protein, 9 aa, Homo Sapiens
SVKTKQIRR

SEQ ID NO: 4921 - protein, 9 aa, Homo Sapiens
FLSMLSATD

SEQ ID NO: 4922 - protein, 9 aa, Homo Sapiens
LVTMLSIFW

SEQ ID NO: 4923 - protein, 9 aa, Homo Sapiens
VTMLSIFWF

SEQ ID NO: 4924 - protein, 9 aa, Homo Sapiens
NVREISFNA

SEQ ID NO: 4925 - protein, 9 aa, Homo Sapiens
SFNACLSHM

SEQ ID NO: 4926 - protein, 9 aa, Homo Sapiens
AMAFDRFVA

SEQ ID NO: 4927 - protein, 9 aa, Homo Sapiens
FVAVSNPLR

SEQ ID NO: 4928 - protein, 9 aa, Homo Sapiens
VIRGLLMLT

SEQ ID NO: 4929 - protein, 9 aa, Homo Sapiens
MVALLIRLS

SEQ ID NO: 4930 - protein, 9 aa, Homo Sapiens
ALLIRLSYC

SEQ ID NO: 4931 - protein, 9 aa, Homo Sapiens
VMKLSCTDT

SEQ ID NO: 4932 - protein, 9 aa, Homo Sapiens
SCTDTRINS

SEQ ID NO: 4933 - protein, 9 aa, Homo Sapiens
CTDTRINSA

SEQ ID NO: 4934 - protein, 9 aa, Homo Sapiens
NSAVGLTAM

SEQ ID NO: 4935 - protein, 9 aa, Homo Sapiens
IRTVLSVAS

SEQ ID NO: 4936 - protein, 9 aa, Homo Sapiens
RTVLSVASP

SEQ ID NO: 4937 - protein, 9 aa, Homo Sapiens
ETFSTCVSH

SEQ ID NO: 4938 - protein, 9 aa, Homo Sapiens
TCVSHIVAF

SEQ ID NO: 4939 - protein, 9 aa, Homo Sapiens
HIVAFAIYY

SEQ ID NO: 4940 - protein, 9 aa, Homo Sapiens
YYIPLISLS

SEQ ID NO: 4941 - protein, 9 aa, Homo Sapiens
SLSIVHRFG

SEQ ID NO: 4942 - protein, 9 aa, Homo Sapiens
SIVHRFGKQ

SEQ ID NO: 4943 - protein, 9 aa, Homo Sapiens
IVHRFGKQA

SEQ ID NO: 4944 - protein, 9 aa, Homo Sapiens
HRFGKQAPA

SEQ ID NO: 4945 - protein, 9 aa, Homo Sapiens
TYLLISPLM

SEQ ID NO: 4946 - protein, 9 aa, Homo Sapiens
LLISPLMNP

SEQ ID NO: 4947 - protein, 9 aa, Homo Sapiens
PLMNPVIYS

SEQ ID NO: 4948 - protein, 9 aa, Homo Sapiens
VIKILHSKE

SEQ ID NO: 4949 - protein, 9 aa, Homo Sapiens
IKILHSKET

SEQ ID NO: 4950 - protein, 9 aa, Homo Sapiens
SMLSATDLG

SEQ ID NO: 4951 - protein, 9 aa, Homo Sapiens
FNVREISFN

SEQ ID NO: 4952 - protein, 9 aa, Homo Sapiens
CLSHMFFIK

SEQ ID NO: 4953 - protein, 9 aa, Homo Sapiens
SHMFFIKFF

SEQ ID NO: 4954 - protein, 9 aa, Homo Sapiens
FIKFFTVME

SEQ ID NO: 4955 - protein, 9 aa, Homo Sapiens
SVLLAMAFD

SEQ ID NO: 4956 - protein, 9 aa, Homo Sapiens
AVSNPLRYA

SEQ ID NO: 4957 - protein, 9 aa, Homo Sapiens
RYAMILTDS

SEQ ID NO: 4958 - protein, 9 aa, Homo Sapiens
TDSRIAQIG

SEQ ID NO: 4959 - protein, 9 aa, Homo Sapiens
LLIRLSYCH

SEQ ID NO: 4960 - protein, 9 aa, Homo Sapiens
SYCHSQVLH

SEQ ID NO: 4961 - protein, 9 aa, Homo Sapiens
QVLHHSYCY

SEQ ID NO: 4962 - protein, 9 aa, Homo Sapiens
VLHHSYCYH

SEQ ID NO: 4963 - protein, 9 aa, Homo Sapiens
PDVMKLSCT

SEQ ID NO: 4964 - protein, 9 aa, Homo Sapiens
RINSAVGLT

SEQ ID NO: 4965 - protein, 9 aa, Homo Sapiens
AVGLTAMFS

SEQ ID NO: 4966 - protein, 9 aa, Homo Sapiens
VLIIRTVLS

SEQ ID NO: 4967 - protein, 9 aa, Homo Sapiens
PEERKETFS

SEQ ID NO: 4968 - protein, 9 aa, Homo Sapiens
CVSHIVAFA

SEQ ID NO: 4969 - protein, 9 aa, Homo Sapiens
LSIVHRFGK

SEQ ID NO: 4970 - protein, 9 aa, Homo Sapiens
RFGKQAPAY

SEQ ID NO: 4971 - protein, 9 aa, Homo Sapiens
KQAPAYVHT

SEQ ID NO: 4972 - protein, 9 aa, Homo Sapiens
AYVHTMIAN

SEQ ID NO: 4973 - protein, 9 aa, Homo Sapiens
ANTYLLISP

SEQ ID NO: 4974 - protein, 9 aa, Homo Sapiens
KQIRRAVIK

SEQ ID NO: 4975 - protein, 9 aa, Homo Sapiens
AVIKILHSK

SEQ ID NO: 4976 - protein, 9 aa, Homo Sapiens
ATDLGLSIS

SEQ ID NO: 4977 - protein, 9 aa, Homo Sapiens
WFNVREISF

SEQ ID NO: 4978 - protein, 9 aa, Homo Sapiens
EISFNACLS

SEQ ID NO: 4979 - protein, 9 aa, Homo Sapiens
FNACLSHMF

SEQ ID NO: 4980 - protein, 9 aa, Homo Sapiens
HMFFIKFFT

SEQ ID NO: 4981 - protein, 9 aa, Homo Sapiens
ESSVLLAMA

SEQ ID NO: 4982 - protein, 9 aa, Homo Sapiens
SSVLLAMAF

SEQ ID NO: 4983 - protein, 9 aa, Homo Sapiens
VSNPLRYAM

SEQ ID NO: 4984 - protein, 9 aa, Homo Sapiens
PLRYAMILT

SEQ ID NO: 4985 - protein, 9 aa, Homo Sapiens
FLLTGVPGL

SEQ ID NO: 4986 - protein, 9 aa, Homo Sapiens
SIIFLLTGV

SEQ ID NO: 4987 - protein, 9 aa, Homo Sapiens
ALLGNSLIL

SEQ ID NO: 4988 - protein, 9 aa, Homo Sapiens
SIPFCFLSV

SEQ ID NO: 4989 - protein, 9 aa, Homo Sapiens
VTALLGNSL

SEQ ID NO: 4990 - protein, 9 aa, Homo Sapiens
FITSTLQNI

SEQ ID NO: 4991 - protein, 9 aa, Homo Sapiens
ITSTSIIFL

SEQ ID NO: 4992 - protein, 9 aa, Homo Sapiens
PMYYFLSML

SEQ ID NO: 4993 - protein, 9 aa, Homo Sapiens
GLEAFHTWI

SEQ ID NO: 4994 - protein, 9 aa, Homo Sapiens
WISIPFCFL

SEQ ID NO: 4995 - protein, 9 aa, Homo Sapiens
SLILFATIT

SEQ ID NO: 4996 - protein, 9 aa, Homo Sapiens
STLQNITST

SEQ ID NO: 4997 - protein, 9 aa, Homo Sapiens
FCFLSVTAL

SEQ ID NO: 4998 - protein, 9 aa, Homo Sapiens
ILFATITQP

SEQ ID NO: 4999 - protein, 9 aa, Homo Sapiens
FATITQPSL

SEQ ID NO: 5000 - protein, 9 aa, Homo Sapiens
CFLSVTALL

SEQ ID NO: 5001 - protein, 9 aa, Homo Sapiens
TALLGNSLI

SEQ ID NO: 5002 - protein, 9 aa, Homo Sapiens
LLGNSLILF

SEQ ID NO: 5003 - protein, 9 aa, Homo Sapiens
SLHEPMYYF

SEQ ID NO: 5004 - protein, 9 aa, Homo Sapiens
NSLILFATI

SEQ ID NO: 5005 - protein, 9 aa, Homo Sapiens
LILFATITQ

SEQ ID NO: 5006 - protein, 9 aa, Homo Sapiens
ITQPSLHEP

SEQ ID NO: 5007 - protein, 9 aa, Homo Sapiens
TLQNITSTS

SEQ ID NO: 5008 - protein, 9 aa, Homo Sapiens
IIFLLTGVP

SEQ ID NO: 5009 - protein, 9 aa, Homo Sapiens
LTGVPGLEA

SEQ ID NO: 5010 - protein, 9 aa, Homo Sapiens
LHEPMYYFL

SEQ ID NO: 5011 - protein, 9 aa, Homo Sapiens
LQNITSTSI

SEQ ID NO: 5012 - protein, 9 aa, Homo Sapiens
TSTSIIFLL

SEQ ID NO: 5013 - protein, 9 aa, Homo Sapiens
LLTGVPGLE

SEQ ID NO: 5014 - protein, 9 aa, Homo Sapiens
LGNSLILFA

SEQ ID NO: 5015 - protein, 9 aa, Homo Sapiens
ITSTLQNIT

SEQ ID NO: 5016 - protein, 9 aa, Homo Sapiens
QNITSTSII

SEQ ID NO: 5017 - protein, 9 aa, Homo Sapiens
EAFHTWISI

SEQ ID NO: 5018 - protein, 9 aa, Homo Sapiens
IPFCFLSVT

SEQ ID NO: 5019 - protein, 9 aa, Homo Sapiens
FLSVTALLG

SEQ ID NO: 5020 - protein, 9 aa, Homo Sapiens
STSIIFLLT

SEQ ID NO: 5021 - protein, 9 aa, Homo Sapiens
TSIIFLLTG

SEQ ID NO: 5022 - protein, 9 aa, Homo Sapiens
GVPGLEAFH

SEQ ID NO: 5023 - protein, 9 aa, Homo Sapiens
HTWISIPFC

SEQ ID NO: 5024 - protein, 9 aa, Homo Sapiens
SVTALLGNS

SEQ ID NO: 5025 - protein, 9 aa, Homo Sapiens
GNSLILFAT

SEQ ID NO: 5026 - protein, 9 aa, Homo Sapiens
TGVPGLEAF

SEQ ID NO: 5027 - protein, 9 aa, Homo Sapiens
TITQPSLHE

SEQ ID NO: 5028 - protein, 9 aa, Homo Sapiens
LSVTALLGN

SEQ ID NO: 5029 - protein, 9 aa, Homo Sapiens
ATITQPSLH

SEQ ID NO: 5030 - protein, 9 aa, Homo Sapiens
NITSTSIIF

SEQ ID NO: 5031 - protein, 9 aa, Homo Sapiens
ISIPFCFLS

SEQ ID NO: 5032 - protein, 9 aa, Homo Sapiens
IFLLTGVPG

SEQ ID NO: 5033 - protein, 9 aa, Homo Sapiens
AFHTWISIP

SEQ ID NO: 5034 - protein, 9 aa, Homo Sapiens
LFATITQPS

SEQ ID NO: 5035 - protein, 9 aa, Homo Sapiens
VPGLEAFHT

SEQ ID NO: 5036 - protein, 9 aa, Homo Sapiens
LEAFHTWIS

SEQ ID NO: 5037 - protein, 9 aa, Homo Sapiens
PFCFLSVTA

SEQ ID NO: 5038 - protein, 9 aa, Homo Sapiens
TQPSLHEPM

SEQ ID NO: 5039 - protein, 9 aa, Homo Sapiens
EPMYYFLSM

SEQ ID NO: 5040 - protein, 9 aa, Homo Sapiens
PGLEAFHTW

SEQ ID NO: 5041 - protein, 9 aa, Homo Sapiens
TWISIPFCF

SEQ ID NO: 5042 - protein, 9 aa, Homo Sapiens
TSTLQNITS

SEQ ID NO: 5043 - protein, 9 aa, Homo Sapiens
QPSLHEPMY

SEQ ID NO: 5044 - protein, 9 aa, Homo Sapiens
HEPMYYFLS

SEQ ID NO: 5045 - protein, 9 aa, Homo Sapiens
PSLHEPMYY

SEQ ID NO: 5046 - protein, 9 aa, Homo Sapiens
STSIIFLLT

SEQ ID NO: 5047 - protein, 9 aa, Homo Sapiens
PSLHEPMYY

SEQ ID NO: 5048 - protein, 9 aa, Homo Sapiens
QPSLHEPMY

SEQ ID NO: 5049 - protein, 9 aa, Homo Sapiens
LTGVPGLEA

SEQ ID NO: 5050 - protein, 9 aa, Homo Sapiens
LHEPMYYFL

SEQ ID NO: 5051 - protein, 9 aa, Homo Sapiens
TSTLQNITS

SEQ ID NO: 5052 - protein, 9 aa, Homo Sapiens
GLEAFHTWI

SEQ ID NO: 5053 - protein, 9 aa, Homo Sapiens
SIPFCFLSV

SEQ ID NO: 5054 - protein, 9 aa, Homo Sapiens
ATITQPSLH

SEQ ID NO: 5055 - protein, 9 aa, Homo Sapiens
ITSTSIIFL

SEQ ID NO: 5056 - protein, 9 aa, Homo Sapiens
TSIIFLLTG

SEQ ID NO: 5057 - protein, 9 aa, Homo Sapiens
ISIPFCFLS

SEQ ID NO: 5058 - protein, 9 aa, Homo Sapiens
FLSVTALLG

SEQ ID NO: 5059 - protein, 9 aa, Homo Sapiens
LSVTALLGN

SEQ ID NO: 5060 - protein, 9 aa, Homo Sapiens
ITQPSLHEP

SEQ ID NO: 5061 - protein, 9 aa, Homo Sapiens
EPMYYFLSM

SEQ ID NO: 5062 - protein, 9 aa, Homo Sapiens
ALLGNSLIL

SEQ ID NO: 5063 - protein, 9 aa, Homo Sapiens
STLQNITST

SEQ ID NO: 5064 - protein, 9 aa, Homo Sapiens
VTALLGNSL

SEQ ID NO: 5065 - protein, 9 aa, Homo Sapiens
LLGNSLILF

SEQ ID NO: 5066 - protein, 9 aa, Homo Sapiens
NSLILFATI

SEQ ID NO: 5067 - protein, 9 aa, Homo Sapiens
TITQPSLHE

SEQ ID NO: 5068 - protein, 9 aa, Homo Sapiens
ITSTLQNIT

SEQ ID NO: 5069 - protein, 9 aa, Homo Sapiens
TSTSIIFLL

SEQ ID NO: 5070 - protein, 9 aa, Homo Sapiens
LLTGVPGLE

SEQ ID NO: 5071 - protein, 9 aa, Homo Sapiens
TGVPGLEAF

SEQ ID NO: 5072 - protein, 9 aa, Homo Sapiens
HTWISIPFC

SEQ ID NO: 5073 - protein, 9 aa, Homo Sapiens
LGNSLILFA

SEQ ID NO: 5074 - protein, 9 aa, Homo Sapiens
FLLTGVPGL

SEQ ID NO: 5075 - protein, 9 aa, Homo Sapiens
FHTWISIPF

SEQ ID NO: 5076 - protein, 9 aa, Homo Sapiens
TALLGNSLI

SEQ ID NO: 5077 - protein, 9 aa, Homo Sapiens
NITSTSIIF

SEQ ID NO: 5078 - protein, 9 aa, Homo Sapiens
EAFHTWISI

SEQ ID NO: 5079 - protein, 9 aa, Homo Sapiens
WISIPFCFL

SEQ ID NO: 5080 - protein, 9 aa, Homo Sapiens
CFLSVTALL

SEQ ID NO: 5081 - protein, 9 aa, Homo Sapiens
LILFATITQ

SEQ ID NO: 5082 - protein, 9 aa, Homo Sapiens
SLHEPMYYF

SEQ ID NO: 5083 - protein, 9 aa, Homo Sapiens
PGLEAFHTW

SEQ ID NO: 5084 - protein, 9 aa, Homo Sapiens
SLILFATIT

SEQ ID NO: 5085 - protein, 9 aa, Homo Sapiens
HEPMYYFLS

SEQ ID NO: 5086 - protein, 9 aa, Homo Sapiens
SIIFLLTGV

SEQ ID NO: 5087 - protein, 9 aa, Homo Sapiens
FCFLSVTAL

SEQ ID NO: 5088 - protein, 9 aa, Homo Sapiens
SVTALLGNS

SEQ ID NO: 5089 - protein, 9 aa, Homo Sapiens
FITSTLQNI

SEQ ID NO: 5090 - protein, 9 aa, Homo Sapiens
TLQNITSTS

SEQ ID NO: 5091 - protein, 9 aa, Homo Sapiens
IIFLLTGVP

SEQ ID NO: 5092 - protein, 9 aa, Homo Sapiens
IFLLTGVPG

SEQ ID NO: 5093 - protein, 9 aa, Homo Sapiens
GVPGLEAFH

SEQ ID NO: 5094 - protein, 9 aa, Homo Sapiens
VPGLEAFHT

SEQ ID NO: 5095 - protein, 9 aa, Homo Sapiens
AFHTWISIP

SEQ ID NO: 5096 - protein, 9 aa, Homo Sapiens
IPFCFLSVT

SEQ ID NO: 5097 - protein, 9 aa, Homo Sapiens
ILFATITQP

SEQ ID NO: 5098 - protein, 9 aa, Homo Sapiens
FATITQPSL

SEQ ID NO: 5099 - protein, 9 aa, Homo Sapiens
PMYYFLSML

SEQ ID NO: 5100 - protein, 9 aa, Homo Sapiens
SLHEPMYYF

SEQ ID NO: 5101 - protein, 9 aa, Homo Sapiens
ITSTSIIFL

SEQ ID NO: 5102 - protein, 9 aa, Homo Sapiens
LLGNSLILF

SEQ ID NO: 5103 - protein, 9 aa, Homo Sapiens
FLLTGVPGL

SEQ ID NO: 5104 - protein, 9 aa, Homo Sapiens
WISIPFCFL

SEQ ID NO: 5105 - protein, 9 aa, Homo Sapiens
NITSTSIIF

SEQ ID NO: 5106 - protein, 9 aa, Homo Sapiens
VTALLGNSL

SEQ ID NO: 5107 - protein, 9 aa, Homo Sapiens
EPMYYFLSM

SEQ ID NO: 5108 - protein, 9 aa, Homo Sapiens
SIIFLLTGV

SEQ ID NO: 5109 - protein, 9 aa, Homo Sapiens
ALLGNSLIL

SEQ ID NO: 5110 - protein, 9 aa, Homo Sapiens
ITQPSLHEP

SEQ ID NO: 5111 - protein, 9 aa, Homo Sapiens
FITSTLQNI

SEQ ID NO: 5112 - protein, 9 aa, Homo Sapiens
TGVPGLEAF

SEQ ID NO: 5113 - protein, 9 aa, Homo Sapiens
STLQNITST

SEQ ID NO: 5114 - protein, 9 aa, Homo Sapiens
HTWISIPFC

SEQ ID NO: 5115 - protein, 9 aa, Homo Sapiens
SIPFCFLSV

SEQ ID NO: 5116 - protein, 9 aa, Homo Sapiens
FCFLSVTAL

SEQ ID NO: 5117 - protein, 9 aa, Homo Sapiens
CFLSVTALL

SEQ ID NO: 5118 - protein, 9 aa, Homo Sapiens
SVTALLGNS

SEQ ID NO: 5119 - protein, 9 aa, Homo Sapiens
GVPGLEAFH

SEQ ID NO: 5120 - protein, 9 aa, Homo Sapiens
ILFATITQP

SEQ ID NO: 5121 - protein, 9 aa, Homo Sapiens
STSIIFLLT

SEQ ID NO: 5122 - protein, 9 aa, Homo Sapiens
ATITQPSLH

SEQ ID NO: 5123 - protein, 9 aa, Homo Sapiens
LHEPMYYFL

SEQ ID NO: 5124 - protein, 9 aa, Homo Sapiens
PMYYFLSML

SEQ ID NO: 5125 - protein, 9 aa, Homo Sapiens
TSTSIIFLL

SEQ ID NO: 5126 - protein, 9 aa, Homo Sapiens
IIFLLTGVP

SEQ ID NO: 5127 - protein, 9 aa, Homo Sapiens
TWISIPFCF

SEQ ID NO: 5128 - protein, 9 aa, Homo Sapiens
TITQPSLHE

SEQ ID NO: 5129 - protein, 9 aa, Homo Sapiens
QPSLHEPMY

SEQ ID NO: 5130 - protein, 9 aa, Homo Sapiens
ITSTLQNIT

SEQ ID NO: 5131 - protein, 9 aa, Homo Sapiens
LTGVPGLEA

SEQ ID NO: 5132 - protein, 9 aa, Homo Sapiens
AFHTWISIP

SEQ ID NO: 5133 - protein, 9 aa, Homo Sapiens
TQPSLHEPM

SEQ ID NO: 5134 - protein, 9 aa, Homo Sapiens
PSLHEPMYY

SEQ ID NO: 5135 - protein, 9 aa, Homo Sapiens
LLTGVPGLE

SEQ ID NO: 5136 - protein, 9 aa, Homo Sapiens
FHTWISIPF

SEQ ID NO: 5137 - protein, 9 aa, Homo Sapiens
SLILFATIT

SEQ ID NO: 5138 - protein, 9 aa, Homo Sapiens
LILFATITQ

SEQ ID NO: 5139 - protein, 9 aa, Homo Sapiens
FATITQPSL

SEQ ID NO: 5140 - protein, 9 aa, Homo Sapiens
TLQNITSTS

SEQ ID NO: 5141 - protein, 9 aa, Homo Sapiens
EAFHTWISI

SEQ ID NO: 5142 - protein, 9 aa, Homo Sapiens
GLEAFHTWI

SEQ ID NO: 5143 - protein, 9 aa, Homo Sapiens
PFCFLSVTA

SEQ ID NO: 5144 - protein, 9 aa, Homo Sapiens
FLSVTALLG

SEQ ID NO: 5145 - protein, 9 aa, Homo Sapiens
LFATITQPS

SEQ ID NO: 5146 - protein, 9 aa, Homo Sapiens
IFLLTGVPG

SEQ ID NO: 5147 - protein, 9 aa, Homo Sapiens
IPFCFLSVT

SEQ ID NO: 5148 - protein, 9 aa, Homo Sapiens
TSIIFLLTG

SEQ ID NO: 5149 - protein, 9 aa, Homo Sapiens
PGLEAFHTW

SEQ ID NO: 5150 - protein, 9 aa, Homo Sapiens
LGNSLILFA

SEQ ID NO: 5151 - protein, 9 aa, Homo Sapiens
NSLILFATI

SEQ ID NO: 5152 - protein, 9 aa, Homo Sapiens
LSVTALLGN

SEQ ID NO: 5153 - protein, 9 aa, Homo Sapiens
GNSLILFAT

SEQ ID NO: 5154 - protein, 9 aa, Homo Sapiens
HEPMYYFLS

SEQ ID NO: 5155 - protein, 9 aa, Homo Sapiens
QNITSTSII

SEQ ID NO: 5156 - protein, 9 aa, Homo Sapiens
ISIPFCFLS

SEQ ID NO: 5157 - protein, 9 aa, Homo Sapiens
TSTLQNITS

SEQ ID NO: 5158 - protein, 9 aa, Homo Sapiens
LQNITSTSI

SEQ ID NO: 5159 - protein, 9 aa, Homo Sapiens
VPGLEAFHT

SEQ ID NO: 5160 - protein, 9 aa, Homo Sapiens
LEAFHTWIS

SEQ ID NO: 5161 - protein, 9 aa, Homo Sapiens
TALLGNSLI

SEQ ID NO: 5162 - protein, 9 aa, Homo Sapiens
ALLGNSLIL

SEQ ID NO: 5163 - protein, 9 aa, Homo Sapiens
GVPGLEAFH

SEQ ID NO: 5164 - protein, 9 aa, Homo Sapiens
SLILFATIT

SEQ ID NO: 5165 - protein, 9 aa, Homo Sapiens
TLQNITSTS

SEQ ID NO: 5166 - protein, 9 aa, Homo Sapiens
ILFATITQP

SEQ ID NO: 5167 - protein, 9 aa, Homo Sapiens
IIFLLTGVP

SEQ ID NO: 5168 - protein, 9 aa, Homo Sapiens
FLSVTALLG

SEQ ID NO: 5169 - protein, 9 aa, Homo Sapiens
SLHEPMYYF

SEQ ID NO: 5170 - protein, 9 aa, Homo Sapiens
LLTGVPGLE

SEQ ID NO: 5171 - protein, 9 aa, Homo Sapiens
LLGNSLILF

SEQ ID NO: 5172 - protein, 9 aa, Homo Sapiens
FLLTGVPGL

SEQ ID NO: 5173 - protein, 9 aa, Homo Sapiens
GLEAFHTWI

SEQ ID NO: 5174 - protein, 9 aa, Homo Sapiens
SIPFCFLSV

SEQ ID NO: 5175 - protein, 9 aa, Homo Sapiens
SVTALLGNS

SEQ ID NO: 5176 - protein, 9 aa, Homo Sapiens
LILFATITQ

SEQ ID NO: 5177 - protein, 9 aa, Homo Sapiens
ATITQPSLH

SEQ ID NO: 5178 - protein, 9 aa, Homo Sapiens
SIIFLLTGV

SEQ ID NO: 5179 - protein, 9 aa, Homo Sapiens
NITSTSIIF

SEQ ID NO: 5180 - protein, 9 aa, Homo Sapiens
IFLLTGVPG

SEQ ID NO: 5181 - protein, 9 aa, Homo Sapiens
TSIIFLLTG

SEQ ID NO: 5182 - protein, 9 aa, Homo Sapiens
TITQPSLHE

SEQ ID NO: 5183 - protein, 9 aa, Homo Sapiens
TGVPGLEAF

SEQ ID NO: 5184 - protein, 9 aa, Homo Sapiens
NSLILFATI

SEQ ID NO: 5185 - protein, 9 aa, Homo Sapiens
QPSLHEPMY

SEQ ID NO: 5186 - protein, 9 aa, Homo Sapiens
PSLHEPMYY

SEQ ID NO: 5187 - protein, 9 aa, Homo Sapiens
WISIPFCFL

SEQ ID NO: 5188 - protein, 9 aa, Homo Sapiens
IPFCFLSVT

SEQ ID NO: 5189 - protein, 9 aa, Homo Sapiens
FITSTLQNI

SEQ ID NO: 5190 - protein, 9 aa, Homo Sapiens
QNITSTSII

SEQ ID NO: 5191 - protein, 9 aa, Homo Sapiens
TWISIPFCF

SEQ ID NO: 5192 - protein, 9 aa, Homo Sapiens
ISIPFCFLS

SEQ ID NO: 5193 - protein, 9 aa, Homo Sapiens
PFCFLSVTA

SEQ ID NO: 5194 - protein, 9 aa, Homo Sapiens
TALLGNSLI

SEQ ID NO: 5195 - protein, 9 aa, Homo Sapiens
PMYYFLSML

SEQ ID NO: 5196 - protein, 9 aa, Homo Sapiens
PGLEAFHTW

SEQ ID NO: 5197 - protein, 9 aa, Homo Sapiens
VTALLGNSL

SEQ ID NO: 5198 - protein, 9 aa, Homo Sapiens
STLQNITST

SEQ ID NO: 5199 - protein, 9 aa, Homo Sapiens
LTGVPGLEA

SEQ ID NO: 5200 - protein, 9 aa, Homo Sapiens
AFHTWISIP

SEQ ID NO: 5201 - protein, 9 aa, Homo Sapiens
CFLSVTALL

SEQ ID NO: 5202 - protein, 9 aa, Homo Sapiens
TSTLQNITS

SEQ ID NO: 5203 - protein, 9 aa, Homo Sapiens
STSIIFLLT

SEQ ID NO: 5204 - protein, 9 aa, Homo Sapiens
ITQPSLHEP

SEQ ID NO: 5205 - protein, 9 aa, Homo Sapiens
EPMYYFLSM

SEQ ID NO: 5206 - protein, 9 aa, Homo Sapiens
LQNITSTSI

SEQ ID NO: 5207 - protein, 9 aa, Homo Sapiens
VPGLEAFHT

SEQ ID NO: 5208 - protein, 9 aa, Homo Sapiens
FHTWISIPF

SEQ ID NO: 5209 - protein, 9 aa, Homo Sapiens
FCFLSVTAL

SEQ ID NO: 5210 - protein, 9 aa, Homo Sapiens
LSVTALLGN

SEQ ID NO: 5211 - protein, 9 aa, Homo Sapiens
LGNSLILFA

SEQ ID NO: 5212 - protein, 9 aa, Homo Sapiens
FATITQPSL

SEQ ID NO: 5213 - protein, 9 aa, Homo Sapiens
LHEPMYYFL

SEQ ID NO: 5214 - protein, 9 aa, Homo Sapiens
ITSTLQNIT

SEQ ID NO: 5215 - protein, 9 aa, Homo Sapiens
ITSTSIIFL

SEQ ID NO: 5216 - protein, 9 aa, Homo Sapiens
EAFHTWISI

SEQ ID NO: 5217 - protein, 9 aa, Homo Sapiens
GNSLILFAT

SEQ ID NO: 5218 - protein, 9 aa, Homo Sapiens
LEAFHTWIS

SEQ ID NO: 5219 - protein, 9 aa, Homo Sapiens
HTWISIPFC

SEQ ID NO: 5220 - protein, 9 aa, Homo Sapiens
LFATITQPS

SEQ ID NO: 5221 - protein, 9 aa, Homo Sapiens
EPMYYFLSM

SEQ ID NO: 5222 - protein, 9 aa, Homo Sapiens
IPFCFLSVT

SEQ ID NO: 5223 - protein, 9 aa, Homo Sapiens
VPGLEAFHT

SEQ ID NO: 5224 - protein, 9 aa, Homo Sapiens
WISIPFCFL

SEQ ID NO: 5225 - protein, 9 aa, Homo Sapiens
ALLGNSLIL

SEQ ID NO: 5226 - protein, 9 aa, Homo Sapiens
ITSTSIIFL

SEQ ID NO: 5227 - protein, 9 aa, Homo Sapiens
LTGVPGLEA

SEQ ID NO: 5228 - protein, 9 aa, Homo Sapiens
FCFLSVTAL

SEQ ID NO: 5229 - protein, 9 aa, Homo Sapiens
QPSLHEPMY

SEQ ID NO: 5230 - protein, 9 aa, Homo Sapiens
FLLTGVPGL

SEQ ID NO: 5231 - protein, 9 aa, Homo Sapiens
CFLSVTALL

SEQ ID NO: 5232 - protein, 9 aa, Homo Sapiens
VTALLGNSL

SEQ ID NO: 5233 - protein, 9 aa, Homo Sapiens
LHEPMYYFL

SEQ ID NO: 5234 - protein, 9 aa, Homo Sapiens
STSIIFLLT

SEQ ID NO: 5235 - protein, 9 aa, Homo Sapiens
FATITQPSL

SEQ ID NO: 5236 - protein, 9 aa, Homo Sapiens
TSTSIIFLL

SEQ ID NO: 5237 - protein, 9 aa, Homo Sapiens
PMYYFLSML

SEQ ID NO: 5238 - protein, 9 aa, Homo Sapiens
ITSTLQNIT

SEQ ID NO: 5239 - protein, 9 aa, Homo Sapiens
SIPFCFLSV

SEQ ID NO: 5240 - protein, 9 aa, Homo Sapiens
LGNSLILFA

SEQ ID NO: 5241 - protein, 9 aa, Homo Sapiens
GNSLILFAT

SEQ ID NO: 5242 - protein, 9 aa, Homo Sapiens
SLHEPMYYF

SEQ ID NO: 5243 - protein, 9 aa, Homo Sapiens
TGVPGLEAF

SEQ ID NO: 5244 - protein, 9 aa, Homo Sapiens
GLEAFHTWI

SEQ ID NO: 5245 - protein, 9 aa, Homo Sapiens
PFCFLSVTA

SEQ ID NO: 5246 - protein, 9 aa, Homo Sapiens
NSLILFATI

SEQ ID NO: 5247 - protein, 9 aa, Homo Sapiens
STLQNITST

SEQ ID NO: 5248 - protein, 9 aa, Homo Sapiens
LQNITSTSI

SEQ ID NO: 5249 - protein, 9 aa, Homo Sapiens
QNITSTSII

SEQ ID NO: 5250 - protein, 9 aa, Homo Sapiens
SIIFLLTGV

SEQ ID NO: 5251 - protein, 9 aa, Homo Sapiens
EAFHTWISI

SEQ ID NO: 5252 - protein, 9 aa, Homo Sapiens
FHTWISIPF

SEQ ID NO: 5253 - protein, 9 aa, Homo Sapiens
LLGNSLILF

SEQ ID NO: 5254 - protein, 9 aa, Homo Sapiens
SLILFATIT

SEQ ID NO: 5255 - protein, 9 aa, Homo Sapiens
TQPSLHEPM

SEQ ID NO: 5256 - protein, 9 aa, Homo Sapiens
FITSTLQNI

SEQ ID NO: 5257 - protein, 9 aa, Homo Sapiens
NITSTSIIF

SEQ ID NO: 5258 - protein, 9 aa, Homo Sapiens
TWISIPFCF

SEQ ID NO: 5259 - protein, 9 aa, Homo Sapiens
TALLGNSLI

SEQ ID NO: 5260 - protein, 9 aa, Homo Sapiens
IFLLTGVPG

SEQ ID NO: 5261 - protein, 9 aa, Homo Sapiens
TITQPSLHE

SEQ ID NO: 5262 - protein, 9 aa, Homo Sapiens
GVPGLEAFH

SEQ ID NO: 5263 - protein, 9 aa, Homo Sapiens
FLSVTALLG

SEQ ID NO: 5264 - protein, 9 aa, Homo Sapiens
IIFLLTGVP

SEQ ID NO: 5265 - protein, 9 aa, Homo Sapiens
ILFATITQP

SEQ ID NO: 5266 - protein, 9 aa, Homo Sapiens
LFATITQPS

SEQ ID NO: 5267 - protein, 9 aa, Homo Sapiens
TSIIFLLTG

SEQ ID NO: 5268 - protein, 9 aa, Homo Sapiens
LLTGVPGLE

SEQ ID NO: 5269 - protein, 9 aa, Homo Sapiens
LEAFHTWIS

SEQ ID NO: 5270 - protein, 9 aa, Homo Sapiens
AFHTWISIP

SEQ ID NO: 5271 - protein, 9 aa, Homo Sapiens
HTWISIPFC

SEQ ID NO: 5272 - protein, 9 aa, Homo Sapiens
ISIPFCFLS

SEQ ID NO: 5273 - protein, 9 aa, Homo Sapiens
LSVTALLGN

SEQ ID NO: 5274 - protein, 9 aa, Homo Sapiens
ATITQPSLH

SEQ ID NO: 5275 - protein, 9 aa, Homo Sapiens
ITQPSLHEP

SEQ ID NO: 5276 - protein, 9 aa, Homo Sapiens
TLQNITSTS

SEQ ID NO: 5277 - protein, 9 aa, Homo Sapiens
PGLEAFHTW

SEQ ID NO: 5278 - protein, 9 aa, Homo Sapiens
SVTALLGNS

SEQ ID NO: 5279 - protein, 9 aa, Homo Sapiens
LILFATITQ

SEQ ID NO: 5280 - protein, 9 aa, Homo Sapiens
FLLTGVPGL

SEQ ID NO: 5281 - protein, 9 aa, Homo Sapiens
ALLGNSLIL

SEQ ID NO: 5282 - protein, 9 aa, Homo Sapiens
SLHEPMYYF

SEQ ID NO: 5283 - protein, 9 aa, Homo Sapiens
FATITQPSL

SEQ ID NO: 5284 - protein, 9 aa, Homo Sapiens
WISIPFCFL

SEQ ID NO: 5285 - protein, 9 aa, Homo Sapiens
FCFLSVTAL

SEQ ID NO: 5286 - protein, 9 aa, Homo Sapiens
GLEAFHTWI

SEQ ID NO: 5287 - protein, 9 aa, Homo Sapiens
ITSTSIIFL

SEQ ID NO: 5288 - protein, 9 aa, Homo Sapiens
EAFHTWISI

SEQ ID NO: 5289 - protein, 9 aa, Homo Sapiens
VTALLGNSL

SEQ ID NO: 5290 - protein, 9 aa, Homo Sapiens
TALLGNSLI

SEQ ID NO: 5291 - protein, 9 aa, Homo Sapiens
LLGNSLILF

SEQ ID NO: 5292 - protein, 9 aa, Homo Sapiens
FITSTLQNI

SEQ ID NO: 5293 - protein, 9 aa, Homo Sapiens
TSTSIIFLL

SEQ ID NO: 5294 - protein, 9 aa, Homo Sapiens
PMYYFLSML

SEQ ID NO: 5295 - protein, 9 aa, Homo Sapiens
NITSTSIIF

SEQ ID NO: 5296 - protein, 9 aa, Homo Sapiens
CFLSVTALL

SEQ ID NO: 5297 - protein, 9 aa, Homo Sapiens
LHEPMYYFL

SEQ ID NO: 5298 - protein, 9 aa, Homo Sapiens
SLILFATIT

SEQ ID NO: 5299 - protein, 9 aa, Homo Sapiens
EPMYYFLSM

SEQ ID NO: 5300 - protein, 9 aa, Homo Sapiens
VPGLEAFHT

SEQ ID NO: 5301 - protein, 9 aa, Homo Sapiens
FLSVTALLG

SEQ ID NO: 5302 - protein, 9 aa, Homo Sapiens
ILFATITQP

SEQ ID NO: 5303 - protein, 9 aa, Homo Sapiens
TGVPGLEAF

SEQ ID NO: 5304 - protein, 9 aa, Homo Sapiens
FHTWISIPF

SEQ ID NO: 5305 - protein, 9 aa, Homo Sapiens
IPFCFLSVT

SEQ ID NO: 5306 - protein, 9 aa, Homo Sapiens
QPSLHEPMY

SEQ ID NO: 5307 - protein, 9 aa, Homo Sapiens
TLQNITSTS

SEQ ID NO: 5308 - protein, 9 aa, Homo Sapiens
LQNITSTSI

SEQ ID NO: 5309 - protein, 9 aa, Homo Sapiens
QNITSTSII

SEQ ID NO: 5310 - protein, 9 aa, Homo Sapiens
SIIFLLTGV

SEQ ID NO: 5311 - protein, 9 aa, Homo Sapiens
IIFLLTGVP

SEQ ID NO: 5312 - protein, 9 aa, Homo Sapiens
LLTGVPGLE

SEQ ID NO: 5313 - protein, 9 aa, Homo Sapiens
TWISIPFCF

SEQ ID NO: 5314 - protein, 9 aa, Homo Sapiens
SIPFCFLSV

SEQ ID NO: 5315 - protein, 9 aa, Homo Sapiens
NSLILFATI

SEQ ID NO: 5316 - protein, 9 aa, Homo Sapiens
LILFATITQ

SEQ ID NO: 5317 - protein, 9 aa, Homo Sapiens
TITQPSLHE

SEQ ID NO: 5318 - protein, 9 aa, Homo Sapiens
STLQNITST

SEQ ID NO: 5319 - protein, 9 aa, Homo Sapiens
IFLLTGVPG

SEQ ID NO: 5320 - protein, 9 aa, Homo Sapiens
GNSLILFAT

SEQ ID NO: 5321 - protein, 9 aa, Homo Sapiens
TSTLQNITS

SEQ ID NO: 5322 - protein, 9 aa, Homo Sapiens
STSIIFLLT

SEQ ID NO: 5323 - protein, 9 aa, Homo Sapiens
LTGVPGLEA

SEQ ID NO: 5324 - protein, 9 aa, Homo Sapiens
PGLEAFHTW

SEQ ID NO: 5325 - protein, 9 aa, Homo Sapiens
HTWISIPFC

SEQ ID NO: 5326 - protein, 9 aa, Homo Sapiens
SVTALLGNS

SEQ ID NO: 5327 - protein, 9 aa, Homo Sapiens
ITQPSLHEP

SEQ ID NO: 5328 - protein, 9 aa, Homo Sapiens
ITSTLQNIT

SEQ ID NO: 5329 - protein, 9 aa, Homo Sapiens
GVPGLEAFH

SEQ ID NO: 5330 - protein, 9 aa, Homo Sapiens
AFHTWISIP

SEQ ID NO: 5331 - protein, 9 aa, Homo Sapiens
ISIPFCFLS

SEQ ID NO: 5332 - protein, 9 aa, Homo Sapiens
PFCFLSVTA

SEQ ID NO: 5333 - protein, 9 aa, Homo Sapiens
LGNSLILFA

SEQ ID NO: 5334 - protein, 9 aa, Homo Sapiens
HEPMYYFLS

SEQ ID NO: 5335 - protein, 9 aa, Homo Sapiens
LHEPMYYFL

SEQ ID NO: 5336 - protein, 9 aa, Homo Sapiens
FHTWISIPF

SEQ ID NO: 5337 - protein, 9 aa, Homo Sapiens
ITSTSIIFL

SEQ ID NO: 5338 - protein, 9 aa, Homo Sapiens
FLLTGVPGL

SEQ ID NO: 5339 - protein, 9 aa, Homo Sapiens
TSTSIIFLL

SEQ ID NO: 5340 - protein, 9 aa, Homo Sapiens
WISIPFCFL

SEQ ID NO: 5341 - protein, 9 aa, Homo Sapiens
FCFLSVTAL

SEQ ID NO: 5342 - protein, 9 aa, Homo Sapiens
ALLGNSLIL

SEQ ID NO: 5343 - protein, 9 aa, Homo Sapiens
TGVPGLEAF

SEQ ID NO: 5344 - protein, 9 aa, Homo Sapiens
VTALLGNSL

SEQ ID NO: 5345 - protein, 9 aa, Homo Sapiens
FATITQPSL

SEQ ID NO: 5346 - protein, 9 aa, Homo Sapiens
CFLSVTALL

SEQ ID NO: 5347 - protein, 9 aa, Homo Sapiens
PMYYFLSML

SEQ ID NO: 5348 - protein, 9 aa, Homo Sapiens
SLHEPMYYF

SEQ ID NO: 5349 - protein, 9 aa, Homo Sapiens
TWISIPFCF

SEQ ID NO: 5350 - protein, 9 aa, Homo Sapiens
TQPSLHEPM

SEQ ID NO: 5351 - protein, 9 aa, Homo Sapiens
EPMYYFLSM

SEQ ID NO: 5352 - protein, 9 aa, Homo Sapiens
NITSTSIIF

SEQ ID NO: 5353 - protein, 9 aa, Homo Sapiens
LLGNSLILF

SEQ ID NO: 5354 - protein, 9 aa, Homo Sapiens
ITQPSLHEP

SEQ ID NO: 5355 - protein, 9 aa, Homo Sapiens
IIFLLTGVP

SEQ ID NO: 5356 - protein, 9 aa, Homo Sapiens
IFLLTGVPG

SEQ ID NO: 5357 - protein, 9 aa, Homo Sapiens
ISIPFCFLS

SEQ ID NO: 5358 - protein, 9 aa, Homo Sapiens
IPFCFLSVT

SEQ ID NO: 5359 - protein, 9 aa, Homo Sapiens
ITSTLQNIT

SEQ ID NO: 5360 - protein, 9 aa, Homo Sapiens
STLQNITST

SEQ ID NO: 5361 - protein, 9 aa, Homo Sapiens
LTGVPGLEA

SEQ ID NO: 5362 - protein, 9 aa, Homo Sapiens
PFCFLSVTA

SEQ ID NO: 5363 - protein, 9 aa, Homo Sapiens
GNSLILFAT

SEQ ID NO: 5364 - protein, 9 aa, Homo Sapiens
ILFATITQP

SEQ ID NO: 5365 - protein, 9 aa, Homo Sapiens
TITQPSLHE

SEQ ID NO: 5366 - protein, 9 aa, Homo Sapiens
TSTLQNITS

SEQ ID NO: 5367 - protein, 9 aa, Homo Sapiens
TLQNITSTS

SEQ ID NO: 5368 - protein, 9 aa, Homo Sapiens
TSIIFLLTG

SEQ ID NO: 5369 - protein, 9 aa, Homo Sapiens
LLTGVPGLE

SEQ ID NO: 5370 - protein, 9 aa, Homo Sapiens
GVPGLEAFH

SEQ ID NO: 5371 - protein, 9 aa, Homo Sapiens
PGLEAFHTW

SEQ ID NO: 5372 - protein, 9 aa, Homo Sapiens
GLEAFHTWI

SEQ ID NO: 5373 - protein, 9 aa, Homo Sapiens
HTWISIPFC

SEQ ID NO: 5374 - protein, 9 aa, Homo Sapiens
FLSVTALLG

SEQ ID NO: 5375 - protein, 9 aa, Homo Sapiens
TALLGNSLI

SEQ ID NO: 5376 - protein, 9 aa, Homo Sapiens
QPSLHEPMY

SEQ ID NO: 5377 - protein, 9 aa, Homo Sapiens
STSIIFLLT

SEQ ID NO: 5378 - protein, 9 aa, Homo Sapiens
LEAFHTWIS

SEQ ID NO: 5379 - protein, 9 aa, Homo Sapiens
EAFHTWISI

SEQ ID NO: 5380 - protein, 9 aa, Homo Sapiens
AFHTWISIP

SEQ ID NO: 5381 - protein, 9 aa, Homo Sapiens
LGNSLILFA

SEQ ID NO: 5382 - protein, 9 aa, Homo Sapiens
NSLILFATI

SEQ ID NO: 5383 - protein, 9 aa, Homo Sapiens
LILFATITQ

SEQ ID NO: 5384 - protein, 9 aa, Homo Sapiens
LFATITQPS

SEQ ID NO: 5385 - protein, 9 aa, Homo Sapiens
ATITQPSLH

SEQ ID NO: 5386 - protein, 9 aa, Homo Sapiens
PSLHEPMYY

SEQ ID NO: 5387 - protein, 9 aa, Homo Sapiens
FCFLSVTAL

SEQ ID NO: 5388 - protein, 9 aa, Homo Sapiens
ALLGNSLIL

SEQ ID NO: 5389 - protein, 9 aa, Homo Sapiens
ITSTSIIFL

SEQ ID NO: 5390 - protein, 9 aa, Homo Sapiens
FLLTGVPGL

SEQ ID NO: 5391 - protein, 9 aa, Homo Sapiens
TGVPGLEAF

SEQ ID NO: 5392 - protein, 9 aa, Homo Sapiens
GVPGLEAFH

SEQ ID NO: 5393 - protein, 9 aa, Homo Sapiens
TSTSIIFLL

SEQ ID NO: 5394 - protein, 9 aa, Homo Sapiens
CFLSVTALL

SEQ ID NO: 5395 - protein, 9 aa, Homo Sapiens
VTALLGNSL

SEQ ID NO: 5396 - protein, 9 aa, Homo Sapiens
FATITQPSL

SEQ ID NO: 5397 - protein, 9 aa, Homo Sapiens
PMYYFLSML

SEQ ID NO: 5398 - protein, 9 aa, Homo Sapiens
FHTWISIPF

SEQ ID NO: 5399 - protein, 9 aa, Homo Sapiens
TWISIPFCF

SEQ ID NO: 5400 - protein, 9 aa, Homo Sapiens
TALLGNSLI

SEQ ID NO: 5401 - protein, 9 aa, Homo Sapiens
LLGNSLILF

SEQ ID NO: 5402 - protein, 9 aa, Homo Sapiens
SLHEPMYYF

SEQ ID NO: 5403 - protein, 9 aa, Homo Sapiens
NITSTSIIF

SEQ ID NO: 5404 - protein, 9 aa, Homo Sapiens
ATITQPSLH

SEQ ID NO: 5405 - protein, 9 aa, Homo Sapiens
PSLHEPMYY

SEQ ID NO: 5406 - protein, 9 aa, Homo Sapiens
LHEPMYYFL

SEQ ID NO: 5407 - protein, 9 aa, Homo Sapiens
GLEAFHTWI

SEQ ID NO: 5408 - protein, 9 aa, Homo Sapiens
EAFHTWISI

SEQ ID NO: 5409 - protein, 9 aa, Homo Sapiens
WISIPFCFL

SEQ ID NO: 5410 - protein, 9 aa, Homo Sapiens
NSLILFATI

SEQ ID NO: 5411 - protein, 9 aa, Homo Sapiens
STLQNITST

SEQ ID NO: 5412 - protein, 9 aa, Homo Sapiens
LQNITSTSI

SEQ ID NO: 5413 - protein, 9 aa, Homo Sapiens
QNITSTSII

SEQ ID NO: 5414 - protein, 9 aa, Homo Sapiens
ILFATITQP

SEQ ID NO: 5415 - protein, 9 aa, Homo Sapiens
QPSLHEPMY

SEQ ID NO: 5416 - protein, 9 aa, Homo Sapiens
EPMYYFLSM

SEQ ID NO: 5417 - protein, 9 aa, Homo Sapiens
FITSTLQNI

SEQ ID NO: 5418 - protein, 9 aa, Homo Sapiens
TQPSLHEPM

SEQ ID NO: 5419 - protein, 9 aa, Homo Sapiens
IIFLLTGVP

SEQ ID NO: 5420 - protein, 9 aa, Homo Sapiens
IPFCFLSVT

SEQ ID NO: 5421 - protein, 9 aa, Homo Sapiens
SIIFLLTGV

SEQ ID NO: 5422 - protein, 9 aa, Homo Sapiens
GNSLILFAT

SEQ ID NO: 5423 - protein, 9 aa, Homo Sapiens
SLILFATIT

SEQ ID NO: 5424 - protein, 9 aa, Homo Sapiens
ITSTLQNIT

SEQ ID NO: 5425 - protein, 9 aa, Homo Sapiens
TSIIFLLTG

SEQ ID NO: 5426 - protein, 9 aa, Homo Sapiens
IFLLTGVPG

SEQ ID NO: 5427 - protein, 9 aa, Homo Sapiens
AFHTWISIP

SEQ ID NO: 5428 - protein, 9 aa, Homo Sapiens
HTWISIPFC

SEQ ID NO: 5429 - protein, 9 aa, Homo Sapiens
LGNSLILFA

SEQ ID NO: 5430 - protein, 9 aa, Homo Sapiens
TITQPSLHE

SEQ ID NO: 5431 - protein, 9 aa, Homo Sapiens
ITQPSLHEP

SEQ ID NO: 5432 - protein, 9 aa, Homo Sapiens
TSTLQNITS

SEQ ID NO: 5433 - protein, 9 aa, Homo Sapiens
PGLEAFHTW

SEQ ID NO: 5434 - protein, 9 aa, Homo Sapiens
ISIPFCFLS

SEQ ID NO: 5435 - protein, 9 aa, Homo Sapiens
PFCFLSVTA

SEQ ID NO: 5436 - protein, 9 aa, Homo Sapiens
SVTALLGNS

SEQ ID NO: 5437 - protein, 9 aa, Homo Sapiens
LILFATITQ

SEQ ID NO: 5438 - protein, 9 aa, Homo Sapiens
TLQNITSTS

SEQ ID NO: 5439 - protein, 9 aa, Homo Sapiens
LLTGVPGLE

SEQ ID NO: 5440 - protein, 9 aa, Homo Sapiens
LTGVPGLEA

SEQ ID NO: 5441 - protein, 9 aa, Homo Sapiens
VPGLEAFHT

SEQ ID NO: 5442 - protein, 9 aa, Homo Sapiens
LSVTALLGN

SEQ ID NO: 5443 - protein, 9 aa, Homo Sapiens
STSIIFLLT

SEQ ID NO: 5444 - protein, 9 aa, Homo Sapiens
SIPFCFLSV

SEQ ID NO: 5445 - protein, 9 aa, Homo Sapiens
FLSVTALLG

SEQ ID NO: 5446 - protein, 9 aa, Homo Sapiens
LEAFHTWIS

SEQ ID NO: 5447 - protein, 9 aa, Homo Sapiens
LFATITQPS

SEQ ID NO: 5448 - protein, 9 aa, Homo Sapiens
FLLTGVPGL

SEQ ID NO: 5449 - protein, 9 aa, Homo Sapiens
ALLGNSLIL

SEQ ID NO: 5450 - protein, 9 aa, Homo Sapiens
TSTSIIFLL

SEQ ID NO: 5451 - protein, 9 aa, Homo Sapiens
FCFLSVTAL

SEQ ID NO: 5452 - protein, 9 aa, Homo Sapiens
CFLSVTALL

SEQ ID NO: 5453 - protein, 9 aa, Homo Sapiens
FATITQPSL

SEQ ID NO: 5454 - protein, 9 aa, Homo Sapiens
LHEPMYYFL

SEQ ID NO: 5455 - protein, 9 aa, Homo Sapiens
PMYYFLSML

SEQ ID NO: 5456 - protein, 9 aa, Homo Sapiens
FITSTLQNI

SEQ ID NO: 5457 - protein, 9 aa, Homo Sapiens
ITSTSIIFL

SEQ ID NO: 5458 - protein, 9 aa, Homo Sapiens
GLEAFHTWI

SEQ ID NO: 5459 - protein, 9 aa, Homo Sapiens
TWISIPFCF

SEQ ID NO: 5460 - protein, 9 aa, Homo Sapiens
NITSTSIIF

SEQ ID NO: 5461 - protein, 9 aa, Homo Sapiens
TGVPGLEAF

SEQ ID NO: 5462 - protein, 9 aa, Homo Sapiens
EAFHTWISI

SEQ ID NO: 5463 - protein, 9 aa, Homo Sapiens
FHTWISIPF

SEQ ID NO: 5464 - protein, 9 aa, Homo Sapiens
WISIPFCFL

SEQ ID NO: 5465 - protein, 9 aa, Homo Sapiens
VTALLGNSL

SEQ ID NO: 5466 - protein, 9 aa, Homo Sapiens
TALLGNSLI

SEQ ID NO: 5467 - protein, 9 aa, Homo Sapiens
NSLILFATI

SEQ ID NO: 5468 - protein, 9 aa, Homo Sapiens
QNITSTSII

SEQ ID NO: 5469 - protein, 9 aa, Homo Sapiens
SIIFLLTGV

SEQ ID NO: 5470 - protein, 9 aa, Homo Sapiens
SIPFCFLSV

SEQ ID NO: 5471 - protein, 9 aa, Homo Sapiens
TQPSLHEPM

SEQ ID NO: 5472 - protein, 9 aa, Homo Sapiens
SLHEPMYYF

SEQ ID NO: 5473 - protein, 9 aa, Homo Sapiens
EPMYYFLSM

SEQ ID NO: 5474 - protein, 9 aa, Homo Sapiens
LQNITSTSI

SEQ ID NO: 5475 - protein, 9 aa, Homo Sapiens
LLGNSLILF

SEQ ID NO: 5476 - protein, 9 aa, Homo Sapiens
IFLLTGVPG

SEQ ID NO: 5477 - protein, 9 aa, Homo Sapiens
GNSLILFAT

SEQ ID NO: 5478 - protein, 9 aa, Homo Sapiens
ILFATITQP

SEQ ID NO: 5479 - protein, 9 aa, Homo Sapiens
IIFLLTGVP

SEQ ID NO: 5480 - protein, 9 aa, Homo Sapiens
GVPGLEAFH

SEQ ID NO: 5481 - protein, 9 aa, Homo Sapiens
ISIPFCFLS

SEQ ID NO: 5482 - protein, 9 aa, Homo Sapiens
IPFCFLSVT

SEQ ID NO: 5483 - protein, 9 aa, Homo Sapiens
STLQNITST

SEQ ID NO: 5484 - protein, 9 aa, Homo Sapiens
STSIIFLLT

SEQ ID NO: 5485 - protein, 9 aa, Homo Sapiens
TSIIFLLTG

SEQ ID NO: 5486 - protein, 9 aa, Homo Sapiens
PGLEAFHTW

SEQ ID NO: 5487 - protein, 9 aa, Homo Sapiens
FLSVTALLG

SEQ ID NO: 5488 - protein, 9 aa, Homo Sapiens
LSVTALLGN

SEQ ID NO: 5489 - protein, 9 aa, Homo Sapiens
SVTALLGNS

SEQ ID NO: 5490 - protein, 9 aa, Homo Sapiens
LGNSLILFA

SEQ ID NO: 5491 - protein, 9 aa, Homo Sapiens
SLILFATIT

SEQ ID NO: 5492 - protein, 9 aa, Homo Sapiens
LILFATITQ

SEQ ID NO: 5493 - protein, 9 aa, Homo Sapiens
ATITQPSLH

SEQ ID NO: 5494 - protein, 9 aa, Homo Sapiens
TITQPSLHE

SEQ ID NO: 5495 - protein, 9 aa, Homo Sapiens
ITQPSLHEP

SEQ ID NO: 5496 - protein, 9 aa, Homo Sapiens
PSLHEPMYY

SEQ ID NO: 5497 - protein, 9 aa, Homo Sapiens
ITSTLQNIT

SEQ ID NO: 5498 - protein, 9 aa, Homo Sapiens
TSTLQNITS

SEQ ID NO: 5499 - protein, 9 aa, Homo Sapiens
TLQNITSTS

SEQ ID NO: 5500 - protein, 9 aa, Homo Sapiens
LLTGVPGLE

SEQ ID NO: 5501 - protein, 9 aa, Homo Sapiens
LTGVPGLEA

SEQ ID NO: 5502 - protein, 9 aa, Homo Sapiens
VPGLEAFHT

SEQ ID NO: 5503 - protein, 9 aa, Homo Sapiens
AFHTWISIP

SEQ ID NO: 5504 - protein, 9 aa, Homo Sapiens
HTWISIPFC

SEQ ID NO: 5505 - protein, 9 aa, Homo Sapiens
PFCFLSVTA

SEQ ID NO: 5506 - protein, 9 aa, Homo Sapiens
LFATITQPS

SEQ ID NO: 5507 - protein, 9 aa, Homo Sapiens
QPSLHEPMY

SEQ ID NO: 5508 - protein, 9 aa, Homo Sapiens
ALLGNSLIL

SEQ ID NO: 5509 - protein, 9 aa, Homo Sapiens
ITSTSIIFL

SEQ ID NO: 5510 - protein, 9 aa, Homo Sapiens
TGVPGLEAF

SEQ ID NO: 5511 - protein, 9 aa, Homo Sapiens
FCFLSVTAL

SEQ ID NO: 5512 - protein, 9 aa, Homo Sapiens
TSTSIIFLL

SEQ ID NO: 5513 - protein, 9 aa, Homo Sapiens
TWISIPFCF

SEQ ID NO: 5514 - protein, 9 aa, Homo Sapiens
PGLEAFHTW

SEQ ID NO: 5515 - protein, 9 aa, Homo Sapiens
LLGNSLILF

SEQ ID NO: 5516 - protein, 9 aa, Homo Sapiens
QNITSTSII

SEQ ID NO: 5517 - protein, 9 aa, Homo Sapiens
FLLTGVPGL

SEQ ID NO: 5518 - protein, 9 aa, Homo Sapiens
EAFHTWISI

SEQ ID NO: 5519 - protein, 9 aa, Homo Sapiens
CFLSVTALL

SEQ ID NO: 5520 - protein, 9 aa, Homo Sapiens
LHEPMYYFL

SEQ ID NO: 5521 - protein, 9 aa, Homo Sapiens
NITSTSIIF

SEQ ID NO: 5522 - protein, 9 aa, Homo Sapiens
FHTWISIPF

SEQ ID NO: 5523 - protein, 9 aa, Homo Sapiens
WISIPFCFL

SEQ ID NO: 5524 - protein, 9 aa, Homo Sapiens
VTALLGNSL

SEQ ID NO: 5525 - protein, 9 aa, Homo Sapiens
NSLILFATI

SEQ ID NO: 5526 - protein, 9 aa, Homo Sapiens
QPSLHEPMY

SEQ ID NO: 5527 - protein, 9 aa, Homo Sapiens
PSLHEPMYY

SEQ ID NO: 5528 - protein, 9 aa, Homo Sapiens
HEPMYYFLS

SEQ ID NO: 5529 - protein, 9 aa, Homo Sapiens
LEAFHTWIS

SEQ ID NO: 5530 - protein, 9 aa, Homo Sapiens
TALLGNSLI

SEQ ID NO: 5531 - protein, 9 aa, Homo Sapiens
SLHEPMYYF

SEQ ID NO: 5532 - protein, 9 aa, Homo Sapiens
PMYYFLSML

SEQ ID NO: 5533 - protein, 9 aa, Homo Sapiens
FATITQPSL

SEQ ID NO: 5534 - protein, 9 aa, Homo Sapiens
FITSTLQNI

SEQ ID NO: 5535 - protein, 9 aa, Homo Sapiens
ATITQPSLH

SEQ ID NO: 5536 - protein, 9 aa, Homo Sapiens
LQNITSTSI

SEQ ID NO: 5537 - protein, 9 aa, Homo Sapiens
GLEAFHTWI

SEQ ID NO: 5538 - protein, 9 aa, Homo Sapiens
AFHTWISIP

SEQ ID NO: 5539 - protein, 9 aa, Homo Sapiens
ISIPFCFLS

SEQ ID NO: 5540 - protein, 9 aa, Homo Sapiens
STLQNITST

SEQ ID NO: 5541 - protein, 9 aa, Homo Sapiens
STSIIFLLT

SEQ ID NO: 5542 - protein, 9 aa, Homo Sapiens
TSIIFLLTG

SEQ ID NO: 5543 - protein, 9 aa, Homo Sapiens
GNSLILFAT

SEQ ID NO: 5544 - protein, 9 aa, Homo Sapiens
SLILFATIT

SEQ ID NO: 5545 - protein, 9 aa, Homo Sapiens
ILFATITQP

SEQ ID NO: 5546 - protein, 9 aa, Homo Sapiens
SIIFLLTGV

SEQ ID NO: 5547 - protein, 9 aa, Homo Sapiens
IIFLLTGVP

SEQ ID NO: 5548 - protein, 9 aa, Homo Sapiens
ITQPSLHEP

SEQ ID NO: 5549 - protein, 9 aa, Homo Sapiens
EPMYYFLSM

SEQ ID NO: 5550 - protein, 9 aa, Homo Sapiens
TLQNITSTS

SEQ ID NO: 5551 - protein, 9 aa, Homo Sapiens
SIPFCFLSV

SEQ ID NO: 5552 - protein, 9 aa, Homo Sapiens
IPFCFLSVT

SEQ ID NO: 5553 - protein, 9 aa, Homo Sapiens
FLSVTALLG

SEQ ID NO: 5554 - protein, 9 aa, Homo Sapiens
LGNSLILFA

SEQ ID NO: 5555 - protein, 9 aa, Homo Sapiens
LILFATITQ

SEQ ID NO: 5556 - protein, 9 aa, Homo Sapiens
ITSTLQNIT

SEQ ID NO: 5557 - protein, 9 aa, Homo Sapiens
TSTLQNITS

SEQ ID NO: 5558 - protein, 9 aa, Homo Sapiens
IFLLTGVPG

SEQ ID NO: 5559 - protein, 9 aa, Homo Sapiens
LLTGVPGLE

SEQ ID NO: 5560 - protein, 9 aa, Homo Sapiens
HTWISIPFC

SEQ ID NO: 5561 - protein, 9 aa, Homo Sapiens
LSVTALLGN

SEQ ID NO: 5562 - protein, 9 aa, Homo Sapiens
LFATITQPS

SEQ ID NO: 5563 - protein, 9 aa, Homo Sapiens
GVPGLEAFH

SEQ ID NO: 5564 - protein, 9 aa, Homo Sapiens
VPGLEAFHT

SEQ ID NO: 5565 - protein, 9 aa, Homo Sapiens
PFCFLSVTA

SEQ ID NO: 5566 - protein, 9 aa, Homo Sapiens
SVTALLGNS

SEQ ID NO: 5567 - protein, 9 aa, Homo Sapiens
LTGVPGLEA

SEQ ID NO: 5568 - protein, 9 aa, Homo Sapiens
TITQPSLHE

SEQ ID NO: 5569 - protein, 9 aa, Homo Sapiens
TQPSLHEPM

SEQ ID NO: 5570 - protein, 9 aa, Homo Sapiens
TALLGNSLI

SEQ ID NO: 5571 - protein, 9 aa, Homo Sapiens
EAFHTWISI

SEQ ID NO: 5572 - protein, 9 aa, Homo Sapiens
FATITQPSL

SEQ ID NO: 5573 - protein, 9 aa, Homo Sapiens
IPFCFLSVT

SEQ ID NO: 5574 - protein, 9 aa, Homo Sapiens
NSLILFATI

SEQ ID NO: 5575 - protein, 9 aa, Homo Sapiens
LQNITSTSI

SEQ ID NO: 5576 - protein, 9 aa, Homo Sapiens
FITSTLQNI

SEQ ID NO: 5577 - protein, 9 aa, Homo Sapiens
VPGLEAFHT

SEQ ID NO: 5578 - protein, 9 aa, Homo Sapiens
PGLEAFHTW

SEQ ID NO: 5579 - protein, 9 aa, Homo Sapiens
EPMYYFLSM

SEQ ID NO: 5580 - protein, 9 aa, Homo Sapiens
QNITSTSII

SEQ ID NO: 5581 - protein, 9 aa, Homo Sapiens
ITSTSIIFL

SEQ ID NO: 5582 - protein, 9 aa, Homo Sapiens
FLLTGVPGL

SEQ ID NO: 5583 - protein, 9 aa, Homo Sapiens
GLEAFHTWI

SEQ ID NO: 5584 - protein, 9 aa, Homo Sapiens
FCFLSVTAL

SEQ ID NO: 5585 - protein, 9 aa, Homo Sapiens
SIPFCFLSV

SEQ ID NO: 5586 - protein, 9 aa, Homo Sapiens
PMYYFLSML

SEQ ID NO: 5587 - protein, 9 aa, Homo Sapiens
SIIFLLTGV

SEQ ID NO: 5588 - protein, 9 aa, Homo Sapiens
CFLSVTALL

SEQ ID NO: 5589 - protein, 9 aa, Homo Sapiens
ALLGNSLIL

SEQ ID NO: 5590 - protein, 9 aa, Homo Sapiens
LGNSLILFA

SEQ ID NO: 5591 - protein, 9 aa, Homo Sapiens
QPSLHEPMY

SEQ ID NO: 5592 - protein, 9 aa, Homo Sapiens
LHEPMYYFL

SEQ ID NO: 5593 - protein, 9 aa, Homo Sapiens
TSTSIIFLL

SEQ ID NO: 5594 - protein, 9 aa, Homo Sapiens
TGVPGLEAF

SEQ ID NO: 5595 - protein, 9 aa, Homo Sapiens
VTALLGNSL

SEQ ID NO: 5596 - protein, 9 aa, Homo Sapiens
WISIPFCFL

SEQ ID NO: 5597 - protein, 9 aa, Homo Sapiens
LILFATITQ

SEQ ID NO: 5598 - protein, 9 aa, Homo Sapiens
ILFATITQP

SEQ ID NO: 5599 - protein, 9 aa, Homo Sapiens
IIFLLTGVP

SEQ ID NO: 5600 - protein, 9 aa, Homo Sapiens
IFLLTGVPG

SEQ ID NO: 5601 - protein, 9 aa, Homo Sapiens
LLTGVPGLE

SEQ ID NO: 5602 - protein, 9 aa, Homo Sapiens
TSTLQNITS

SEQ ID NO: 5603 - protein, 9 aa, Homo Sapiens
TSIIFLLTG

SEQ ID NO: 5604 - protein, 9 aa, Homo Sapiens
LSVTALLGN

SEQ ID NO: 5605 - protein, 9 aa, Homo Sapiens
LLGNSLILF

SEQ ID NO: 5606 - protein, 9 aa, Homo Sapiens
ITSTLQNIT

SEQ ID NO: 5607 - protein, 9 aa, Homo Sapiens
STLQNITST

SEQ ID NO: 5608 - protein, 9 aa, Homo Sapiens
FLSVTALLG

SEQ ID NO: 5609 - protein, 9 aa, Homo Sapiens
ITQPSLHEP

SEQ ID NO: 5610 - protein, 9 aa, Homo Sapiens
TLQNITSTS

SEQ ID NO: 5611 - protein, 9 aa, Homo Sapiens
NITSTSIIF

SEQ ID NO: 5612 - protein, 9 aa, Homo Sapiens
LTGVPGLEA

SEQ ID NO: 5613 - protein, 9 aa, Homo Sapiens
HTWISIPFC

SEQ ID NO: 5614 - protein, 9 aa, Homo Sapiens
PFCFLSVTA

SEQ ID NO: 5615 - protein, 9 aa, Homo Sapiens
LFATITQPS

SEQ ID NO: 5616 - protein, 9 aa, Homo Sapiens
TITQPSLHE

SEQ ID NO: 5617 - protein, 9 aa, Homo Sapiens
PSLHEPMYY

SEQ ID NO: 5618 - protein, 9 aa, Homo Sapiens
STSIIFLLT

SEQ ID NO: 5619 - protein, 9 aa, Homo Sapiens
GVPGLEAFH

SEQ ID NO: 5620 - protein, 9 aa, Homo Sapiens
LEAFHTWIS

SEQ ID NO: 5621 - protein, 9 aa, Homo Sapiens
LTSPLMNPV

SEQ ID NO: 5622 - protein, 9 aa, Homo Sapiens
NTYLLTSPL

SEQ ID NO: 5623 - protein, 9 aa, Homo Sapiens
LLTSPLMNP

SEQ ID NO: 5624 - protein, 9 aa, Homo Sapiens
MIANTYLLT

SEQ ID NO: 5625 - protein, 9 aa, Homo Sapiens
IANTYLLTS

SEQ ID NO: 5626 - protein, 9 aa, Homo Sapiens
YLLTSPLMN

SEQ ID NO: 5627 - protein, 9 aa, Homo Sapiens
TSPLMNPVI

SEQ ID NO: 5628 - protein, 9 aa, Homo Sapiens
ANTYLLTSP

SEQ ID NO: 5629 - protein, 9 aa, Homo Sapiens
TYLLTSPLM

SEQ ID NO: 5630 - protein, 9 aa, Homo Sapiens
YLLTSPLMN

SEQ ID NO: 5631 - protein, 9 aa, Homo Sapiens
LTSPLMNPV

SEQ ID NO: 5632 - protein, 9 aa, Homo Sapiens
MIANTYLLT

SEQ ID NO: 5633 - protein, 9 aa, Homo Sapiens
IANTYLLTS

SEQ ID NO: 5634 - protein, 9 aa, Homo Sapiens
NTYLLTSPL

SEQ ID NO: 5635 - protein, 9 aa, Homo Sapiens
TSPLMNPVI

SEQ ID NO: 5636 - protein, 9 aa, Homo Sapiens
TYLLTSPLM

SEQ ID NO: 5637 - protein, 9 aa, Homo Sapiens
LLTSPLMNP

SEQ ID NO: 5638 - protein, 9 aa, Homo Sapiens
ANTYLLTSP

SEQ ID NO: 5639 - protein, 9 aa, Homo Sapiens
NTYLLTSPL

SEQ ID NO: 5640 - protein, 9 aa, Homo Sapiens
LTSPLMNPV

SEQ ID NO: 5641 - protein, 9 aa, Homo Sapiens
MIANTYLLT

SEQ ID NO: 5642 - protein, 9 aa, Homo Sapiens
LLTSPLMNP

SEQ ID NO: 5643 - protein, 9 aa, Homo Sapiens
YLLTSPLMN

SEQ ID NO: 5644 - protein, 9 aa, Homo Sapiens
TYLLTSPLM

SEQ ID NO: 5645 - protein, 9 aa, Homo Sapiens
ANTYLLTSP

SEQ ID NO: 5646 - protein, 9 aa, Homo Sapiens
IANTYLLTS

SEQ ID NO: 5647 - protein, 9 aa, Homo Sapiens
TSPLMNPVI

SEQ ID NO: 5648 - protein, 9 aa, Homo Sapiens
YLLTSPLMN

SEQ ID NO: 5649 - protein, 9 aa, Homo Sapiens
MIANTYLLT

SEQ ID NO: 5650 - protein, 9 aa, Homo Sapiens
LLTSPLMNP

SEQ ID NO: 5651 - protein, 9 aa, Homo Sapiens
IANTYLLTS

SEQ ID NO: 5652 - protein, 9 aa, Homo Sapiens
NTYLLTSPL

SEQ ID NO: 5653 - protein, 9 aa, Homo Sapiens
ANTYLLTSP

SEQ ID NO: 5654 - protein, 9 aa, Homo Sapiens
TSPLMNPVI

SEQ ID NO: 5655 - protein, 9 aa, Homo Sapiens
TYLLTSPLM

SEQ ID NO: 5656 - protein, 9 aa, Homo Sapiens
LTSPLMNPV

SEQ ID NO: 5657 - protein, 9 aa, Homo Sapiens
NTYLLTSPL

SEQ ID NO: 5658 - protein, 9 aa, Homo Sapiens
LTSPLMNPV

SEQ ID NO: 5659 - protein, 9 aa, Homo Sapiens
MIANTYLLT

SEQ ID NO: 5660 - protein, 9 aa, Homo Sapiens
TSPLMNPVI

SEQ ID NO: 5661 - protein, 9 aa, Homo Sapiens
TYLLTSPLM

SEQ ID NO: 5662 - protein, 9 aa, Homo Sapiens
IANTYLLTS

SEQ ID NO: 5663 - protein, 9 aa, Homo Sapiens
ANTYLLTSP

SEQ ID NO: 5664 - protein, 9 aa, Homo Sapiens
LLTSPLMNP

SEQ ID NO: 5665 - protein, 9 aa, Homo Sapiens
YLLTSPLMN

SEQ ID NO: 5666 - protein, 9 aa, Homo Sapiens
NTYLLTSPL

SEQ ID NO: 5667 - protein, 9 aa, Homo Sapiens
TSPLMNPVI

SEQ ID NO: 5668 - protein, 9 aa, Homo Sapiens
YLLTSPLMN

SEQ ID NO: 5669 - protein, 9 aa, Homo Sapiens
LLTSPLMNP

SEQ ID NO: 5670 - protein, 9 aa, Homo Sapiens
IANTYLLTS

SEQ ID NO: 5671 - protein, 9 aa, Homo Sapiens
MIANTYLLT

SEQ ID NO: 5672 - protein, 9 aa, Homo Sapiens
ANTYLLTSP

SEQ ID NO: 5673 - protein, 9 aa, Homo Sapiens
TYLLTSPLM

SEQ ID NO: 5674 - protein, 9 aa, Homo Sapiens
NTYLLTSPL

SEQ ID NO: 5675 - protein, 9 aa, Homo Sapiens
TYLLTSPLM

SEQ ID NO: 5676 - protein, 9 aa, Homo Sapiens
LTSPLMNPV

SEQ ID NO: 5677 - protein, 9 aa, Homo Sapiens
TSPLMNPVI

SEQ ID NO: 5678 - protein, 9 aa, Homo Sapiens
IANTYLLTS

SEQ ID NO: 5679 - protein, 9 aa, Homo Sapiens
YLLTSPLMN

SEQ ID NO: 5680 - protein, 9 aa, Homo Sapiens
MIANTYLLT

SEQ ID NO: 5681 - protein, 9 aa, Homo Sapiens
LLTSPLMNP

SEQ ID NO: 5682 - protein, 9 aa, Homo Sapiens
NTYLLTSPL

SEQ ID NO: 5683 - protein, 9 aa, Homo Sapiens
TYLLTSPLM

SEQ ID NO: 5684 - protein, 9 aa, Homo Sapiens
TSPLMNPVI

SEQ ID NO: 5685 - protein, 9 aa, Homo Sapiens
ANTYLLTSP

SEQ ID NO: 5686 - protein, 9 aa, Homo Sapiens
LLTSPLMNP

SEQ ID NO: 5687 - protein, 9 aa, Homo Sapiens
IANTYLLTS

SEQ ID NO: 5688 - protein, 9 aa, Homo Sapiens
YLLTSPLMN

SEQ ID NO: 5689 - protein, 9 aa, Homo Sapiens
LTSPLMNPV

SEQ ID NO: 5690 - protein, 9 aa, Homo Sapiens
MIANTYLLT

SEQ ID NO: 5691 - protein, 9 aa, Homo Sapiens
NTYLLTSPL

SEQ ID NO: 5692 - protein, 9 aa, Homo Sapiens
TYLLTSPLM

SEQ ID NO: 5693 - protein, 9 aa, Homo Sapiens
LTSPLMNPV

SEQ ID NO: 5694 - protein, 9 aa, Homo Sapiens
TSPLMNPVI

SEQ ID NO: 5695 - protein, 9 aa, Homo Sapiens
YLLTSPLMN

SEQ ID NO: 5696 - protein, 9 aa, Homo Sapiens
LLTSPLMNP

SEQ ID NO: 5697 - protein, 9 aa, Homo Sapiens
IANTYLLTS

SEQ ID NO: 5698 - protein, 9 aa, Homo Sapiens
ANTYLLTSP

SEQ ID NO: 5699 - protein, 9 aa, Homo Sapiens
MIANTYLLT

SEQ ID NO: 5700 - protein, 9 aa, Homo Sapiens
NTYLLTSPL

SEQ ID NO: 5701 - protein, 9 aa, Homo Sapiens
TSPLMNPVI

SEQ ID NO: 5702 - protein, 9 aa, Homo Sapiens
LTSPLMNPV

SEQ ID NO: 5703 - protein, 10 aa, Homo Sapiens
VLIIRTVLSV

SEQ ID NO: 5704 - protein, 10 aa, Homo Sapiens
RIAQIGVASV

SEQ ID NO: 5705 - protein, 10 aa, Homo Sapiens
LMLTPMVALL

SEQ ID NO: 5706 - protein, 10 aa, Homo Sapiens
ILTDSRIAQI

SEQ ID NO: 5707 - protein, 10 aa, Homo Sapiens
LLMLTPMVAL

SEQ ID NO: 5708 - protein, 10 aa, Homo Sapiens
AIYYIPLISL

SEQ ID NO: 5709 - protein, 10 aa, Homo Sapiens
SIFWFNVREI

SEQ ID NO: 5710 - protein, 10 aa, Homo Sapiens
DLLLILLSYV

SEQ ID NO: 5711 - protein, 10 aa, Homo Sapiens
LLLILLSYVL

SEQ ID NO: 5712 - protein, 10 aa, Homo Sapiens
LILLSYVLII

SEQ ID NO: 5713 - protein, 10 aa, Homo Sapiens
LLISPLMNPV

SEQ ID NO: 5714 - protein, 10 aa, Homo Sapiens
PLMNPVIYSV

SEQ ID NO: 5715 - protein, 10 aa, Homo Sapiens
SMLSATDLGL

SEQ ID NO: 5716 - protein, 10 aa, Homo Sapiens
LLAMAFDRFV

SEQ ID NO: 5717 - protein, 10 aa, Homo Sapiens
AMAFDRFVAV

SEQ ID NO: 5718 - protein, 10 aa, Homo Sapiens
LLILLSYVLI

SEQ ID NO: 5719 - protein, 10 aa, Homo Sapiens
YIPLISLSIV

SEQ ID NO: 5720 - protein, 10 aa, Homo Sapiens
GLSISTLVTM

SEQ ID NO: 5721 - protein, 10 aa, Homo Sapiens
AMFSTVGVDL

SEQ ID NO: 5722 - protein, 10 aa, Homo Sapiens
FLSMLSATDL

SEQ ID NO: 5723 - protein, 10 aa, Homo Sapiens
LTAMFSTVGV

SEQ ID NO: 5724 - protein, 10 aa, Homo Sapiens
STVGVDLLLI

SEQ ID NO: 5725 - protein, 10 aa, Homo Sapiens
HIVAFAIYYI

SEQ ID NO: 5726 - protein, 10 aa, Homo Sapiens
LISPLMNPVI

SEQ ID NO: 5727 - protein, 10 aa, Homo Sapiens
QIRRAVIKIL

SEQ ID NO: 5728 - protein, 10 aa, Homo Sapiens
TDLGLSISTL

SEQ ID NO: 5729 - protein, 10 aa, Homo Sapiens
TMLSIFWFNV

SEQ ID NO: 5730 - protein, 10 aa, Homo Sapiens
HMFFIKFFTV

SEQ ID NO: 5731 - protein, 10 aa, Homo Sapiens
MLTPMVALLI

SEQ ID NO: 5732 - protein, 10 aa, Homo Sapiens
LIIRTVLSVA

SEQ ID NO: 5733 - protein, 10 aa, Homo Sapiens
DLGLSISTLV

SEQ ID NO: 5734 - protein, 10 aa, Homo Sapiens
RLSYCHSQVL

SEQ ID NO: 5735 - protein, 10 aa, Homo Sapiens
YCYHPDVMKL

SEQ ID NO: 5736 - protein, 10 aa, Homo Sapiens
TVGVDLLLIL

SEQ ID NO: 5737 - protein, 10 aa, Homo Sapiens
LLSYVLIIRT

SEQ ID NO: 5738 - protein, 10 aa, Homo Sapiens
LSYVLIIRTV

SEQ ID NO: 5739 - protein, 10 aa, Homo Sapiens
TMIANTYLLI

SEQ ID NO: 5740 - protein, 10 aa, Homo Sapiens
LSISTLVTML

SEQ ID NO: 5741 - protein, 10 aa, Homo Sapiens
VMESSVLLAM

SEQ ID NO: 5742 - protein, 10 aa, Homo Sapiens
ILLSYVLIIR

SEQ ID NO: 5743 - protein, 10 aa, Homo Sapiens
YLLISPLMNP

SEQ ID NO: 5744 - protein, 10 aa, Homo Sapiens
FTVMESSVLL

SEQ ID NO: 5745 - protein, 10 aa, Homo Sapiens
IGVASVIRGL

SEQ ID NO: 5746 - protein, 10 aa, Homo Sapiens
GVASVIRGLL

SEQ ID NO: 5747 - protein, 10 aa, Homo Sapiens
ASVIRGLLML

SEQ ID NO: 5748 - protein, 10 aa, Homo Sapiens
GLLMLTPMVA

SEQ ID NO: 5749 - protein, 10 aa, Homo Sapiens
AFAIYYIPLI

SEQ ID NO: 5750 - protein, 10 aa, Homo Sapiens
YYIPLISLSI

SEQ ID NO: 5751 - protein, 10 aa, Homo Sapiens
VIYSVKTKQI

SEQ ID NO: 5752 - protein, 10 aa, Homo Sapiens
KQIRRAVIKI

SEQ ID NO: 5753 - protein, 10 aa, Homo Sapiens
TVMESSVLLA

SEQ ID NO: 5754 - protein, 10 aa, Homo Sapiens
AMILTDSRIA

SEQ ID NO: 5755 - protein, 10 aa, Homo Sapiens
SVIRGLLMLT

SEQ ID NO: 5756 - protein, 10 aa, Homo Sapiens
DTRINSAVGL

SEQ ID NO: 5757 - protein, 10 aa, Homo Sapiens
RINSAVGLTA

SEQ ID NO: 5758 - protein, 10 aa, Homo Sapiens
VGVDLLLILL

SEQ ID NO: 5759 - protein, 10 aa, Homo Sapiens
VAFAIYYIPL

SEQ ID NO: 5760 - protein, 10 aa, Homo Sapiens
KQAPAYVHTM

SEQ ID NO: 5761 - protein, 10 aa, Homo Sapiens
HTMIANTYLL

SEQ ID NO: 5762 - protein, 10 aa, Homo Sapiens
LSATDLGLSI

SEQ ID NO: 5763 - protein, 10 aa, Homo Sapiens
YAMILTDSRI

SEQ ID NO: 5764 - protein, 10 aa, Homo Sapiens
TPMVALLIRL

SEQ ID NO: 5765 - protein, 10 aa, Homo Sapiens
ALLIRLSYCH

SEQ ID NO: 5766 - protein, 10 aa, Homo Sapiens
CTDTRINSAV

SEQ ID NO: 5767 - protein, 10 aa, Homo Sapiens
VGLTAMFSTV

SEQ ID NO: 5768 - protein, 10 aa, Homo Sapiens
PLISLSIVHR

SEQ ID NO: 5769 - protein, 10 aa, Homo Sapiens
LISLSIVHRF

SEQ ID NO: 5770 - protein, 10 aa, Homo Sapiens
MIANTYLLIS

SEQ ID NO: 5771 - protein, 10 aa, Homo Sapiens
MLSATDLGLS

SEQ ID NO: 5772 - protein, 10 aa, Homo Sapiens
KFFTVMESSV

SEQ ID NO: 5773 - protein, 10 aa, Homo Sapiens
VSNPLRYAMI

SEQ ID NO: 5774 - protein, 10 aa, Homo Sapiens
IAQIGVASVI

SEQ ID NO: 5775 - protein, 10 aa, Homo Sapiens
VIRGLLMLTP

SEQ ID NO: 5776 - protein, 10 aa, Homo Sapiens
LLIRLSYCHS

SEQ ID NO: 5777 - protein, 10 aa, Homo Sapiens
IRLSYCHSQV

SEQ ID NO: 5778 - protein, 10 aa, Homo Sapiens
MFSTVGVDLL

SEQ ID NO: 5779 - protein, 10 aa, Homo Sapiens
ETFSTCVSHI

SEQ ID NO: 5780 - protein, 10 aa, Homo Sapiens
ANTYLLISPL

SEQ ID NO: 5781 - protein, 10 aa, Homo Sapiens
KTKQIRRAVI

SEQ ID NO: 5782 - protein, 10 aa, Homo Sapiens
FIKFFTVMES

SEQ ID NO: 5783 - protein, 10 aa, Homo Sapiens
VLLAMAFDRF

SEQ ID NO: 5784 - protein, 10 aa, Homo Sapiens
VAVSNPLRYA

SEQ ID NO: 5785 - protein, 10 aa, Homo Sapiens
PLRYAMILTD

SEQ ID NO: 5786 - protein, 10 aa, Homo Sapiens
RGLLMLTPMV

SEQ ID NO: 5787 - protein, 10 aa, Homo Sapiens
LIRLSYCHSQ

SEQ ID NO: 5788 - protein, 10 aa, Homo Sapiens
SCTDTRINSA

SEQ ID NO: 5789 - protein, 10 aa, Homo Sapiens
IIRTVLSVAS

SEQ ID NO: 5790 - protein, 10 aa, Homo Sapiens
VLSVASPEER

SEQ ID NO: 5791 - protein, 10 aa, Homo Sapiens
STCVSHIVAF

SEQ ID NO: 5792 - protein, 10 aa, Homo Sapiens
CVSHIVAFAI

SEQ ID NO: 5793 - protein, 10 aa, Homo Sapiens
SLSIVHRFGK

SEQ ID NO: 5794 - protein, 10 aa, Homo Sapiens
SIVHRFGKQA

SEQ ID NO: 5795 - protein, 10 aa, Homo Sapiens
IANTYLLISP

SEQ ID NO: 5796 - protein, 10 aa, Homo Sapiens
LMNPVIYSVK

SEQ ID NO: 5797 - protein, 10 aa, Homo Sapiens
SVKTKQIRRA

SEQ ID NO: 5798 - protein, 10 aa, Homo Sapiens
VIKILHSKET

SEQ ID NO: 5799 - protein, 10 aa, Homo Sapiens
YYFLSMLSAT

SEQ ID NO: 5800 - protein, 10 aa, Homo Sapiens
ATDLGLSIST

SEQ ID NO: 5801 - protein, 10 aa, Homo Sapiens
ISTLVTMLSI

SEQ ID NO: 5802 - protein, 10 aa, Homo Sapiens
STLVTMLSIF

SEQ ID NO: 5803 - protein, 10 aa, Homo Sapiens
VREISFNACL

SEQ ID NO: 5804 - protein, 10 aa, Homo Sapiens
NACLSHMFFI

SEQ ID NO: 5805 - protein, 10 aa, Homo Sapiens
CLSHMFFIKF

SEQ ID NO: 5806 - protein, 10 aa, Homo Sapiens
MAFDRFVAVS

SEQ ID NO: 5807 - protein, 10 aa, Homo Sapiens
AVSNPLRYAM

SEQ ID NO: 5808 - protein, 10 aa, Homo Sapiens
SNPLRYAMIL

SEQ ID NO: 5809 - protein, 10 aa, Homo Sapiens
QIGVASVIRG

SEQ ID NO: 5810 - protein, 10 aa, Homo Sapiens
VLHHSYCYHP

SEQ ID NO: 5811 - protein, 10 aa, Homo Sapiens
AVGLTAMFST

SEQ ID NO: 5812 - protein, 10 aa, Homo Sapiens
SYVLIIRTVL

SEQ ID NO: 5813 - protein, 10 aa, Homo Sapiens
VASPEERKET

SEQ ID NO: 5814 - protein, 10 aa, Homo Sapiens
RFGKQAPAYV

SEQ ID NO: 5815 - protein, 10 aa, Homo Sapiens
QAPAYVHTMI

SEQ ID NO: 5816 - protein, 10 aa, Homo Sapiens
AYVHTMIANT

SEQ ID NO: 5817 - protein, 10 aa, Homo Sapiens
MLSIFWFNVR

SEQ ID NO: 5818 - protein, 10 aa, Homo Sapiens
ISFNACLSHM

SEQ ID NO: 5819 - protein, 10 aa, Homo Sapiens
LAMAFDRFVA

SEQ ID NO: 5820 - protein, 10 aa, Homo Sapiens
DRFVAVSNPL

SEQ ID NO: 5821 - protein, 10 aa, Homo Sapiens
MILTDSRIAQ

SEQ ID NO: 5822 - protein, 10 aa, Homo Sapiens
TDSRIAQIGV

SEQ ID NO: 5823 - protein, 10 aa, Homo Sapiens
LTPMVALLIR

SEQ ID NO: 5824 - protein, 10 aa, Homo Sapiens
VALLIRLSYC

SEQ ID NO: 5825 - protein, 10 aa, Homo Sapiens
KLSCTDTRIN

SEQ ID NO: 5826 - protein, 10 aa, Homo Sapiens
INSAVGLTAM

SEQ ID NO: 5827 - protein, 10 aa, Homo Sapiens
FSTVGVDLLL

SEQ ID NO: 5828 - protein, 10 aa, Homo Sapiens
TFSTCVSHIV

SEQ ID NO: 5829 - protein, 10 aa, Homo Sapiens
VKTKQIRRAV

SEQ ID NO: 5830 - protein, 10 aa, Homo Sapiens
RAVIKILHSK

SEQ ID NO: 5831 - protein, 10 aa, Homo Sapiens
SATDLGLSIS

SEQ ID NO: 5832 - protein, 10 aa, Homo Sapiens
SISTLVTMLS

SEQ ID NO: 5833 - protein, 10 aa, Homo Sapiens
TLVTMLSIFW

SEQ ID NO: 5834 - protein, 10 aa, Homo Sapiens
FFTVMESSVL

SEQ ID NO: 5835 - protein, 10 aa, Homo Sapiens
MESSVLLAMA

SEQ ID NO: 5836 - protein, 10 aa, Homo Sapiens
VASVIRGLLM

SEQ ID NO: 5837 - protein, 10 aa, Homo Sapiens
IRGLLMLTPM

SEQ ID NO: 5838 - protein, 10 aa, Homo Sapiens
HHSYCYHPDV

SEQ ID NO: 5839 - protein, 10 aa, Homo Sapiens
VMKLSCTDTR

SEQ ID NO: 5840 - protein, 10 aa, Homo Sapiens
MKLSCTDTRI

SEQ ID NO: 5841 - protein, 10 aa, Homo Sapiens
TRINSAVGLT

SEQ ID NO: 5842 - protein, 10 aa, Homo Sapiens
GLTAMFSTVG

SEQ ID NO: 5843 - protein, 10 aa, Homo Sapiens
GVDLLLILLS

SEQ ID NO: 5844 - protein, 10 aa, Homo Sapiens
VDLLLILLSY

SEQ ID NO: 5845 - protein, 10 aa, Homo Sapiens
YVLIIRTVLS

SEQ ID NO: 5846 - protein, 10 aa, Homo Sapiens
SVASPEERKE

SEQ ID NO: 5847 - protein, 10 aa, Homo Sapiens
TCVSHIVAFA

SEQ ID NO: 5848 - protein, 10 aa, Homo Sapiens
VHTMIANTYL

SEQ ID NO: 5849 - protein, 10 aa, Homo Sapiens
NTYLLISPLM

SEQ ID NO: 5850 - protein, 10 aa, Homo Sapiens
AVIKILHSKE

SEQ ID NO: 5851 - protein, 10 aa, Homo Sapiens
LGLSISTLVT

SEQ ID NO: 5852 - protein, 10 aa, Homo Sapiens
LVTMLSIFWF

SEQ ID NO: 5853 - protein, 10 aa, Homo Sapiens
PMVALLIRLS

SEQ ID NO: 5854 - protein, 10 aa, Homo Sapiens
MVALLIRLSY

SEQ ID NO: 5855 - protein, 10 aa, Homo Sapiens
IRTVLSVASP

SEQ ID NO: 5856 - protein, 10 aa, Homo Sapiens
TVLSVASPEE

SEQ ID NO: 5857 - protein, 10 aa, Homo Sapiens
YVHTMIANTY

SEQ ID NO: 5858 - protein, 10 aa, Homo Sapiens
YFLSMLSATD

SEQ ID NO: 5859 - protein, 10 aa, Homo Sapiens
NVREISFNAC

SEQ ID NO: 5860 - protein, 10 aa, Homo Sapiens
SVLLAMAFDR

SEQ ID NO: 5861 - protein, 10 aa, Homo Sapiens
FVAVSNPLRY

SEQ ID NO: 5862 - protein, 10 aa, Homo Sapiens
AQIGVASVIR

SEQ ID NO: 5863 - protein, 10 aa, Homo Sapiens
HPDVMKLSCT

SEQ ID NO: 5864 - protein, 10 aa, Homo Sapiens
DVMKLSCTDT

SEQ ID NO: 5865 - protein, 10 aa, Homo Sapiens
SAVGLTAMFS

SEQ ID NO: 5866 - protein, 10 aa, Homo Sapiens
TAMFSTVGVD

SEQ ID NO: 5867 - protein, 10 aa, Homo Sapiens
ERKETFSTCV

SEQ ID NO: 5868 - protein, 10 aa, Homo Sapiens
IVAFAIYYIP

SEQ ID NO: 5869 - protein, 10 aa, Homo Sapiens
SPLMNPVIYS

SEQ ID NO: 5870 - protein, 10 aa, Homo Sapiens
MNPVIYSVKT

SEQ ID NO: 5871 - protein, 10 aa, Homo Sapiens
MYYFLSMLSA

SEQ ID NO: 5872 - protein, 10 aa, Homo Sapiens
EISFNACLSH

SEQ ID NO: 5873 - protein, 10 aa, Homo Sapiens
LRYAMILTDS

SEQ ID NO: 5874 - protein, 10 aa, Homo Sapiens
DSRIAQIGVA

SEQ ID NO: 5875 - protein, 10 aa, Homo Sapiens
SRIAQIGVAS

SEQ ID NO: 5876 - protein, 10 aa, Homo Sapiens
SYCHSQVLHH

SEQ ID NO: 5877 - protein, 10 aa, Homo Sapiens
YCHSQVLHHS

SEQ ID NO: 5878 - protein, 10 aa, Homo Sapiens
FAIYYIPLIS

SEQ ID NO: 5879 - protein, 10 aa, Homo Sapiens
IYYIPLISLS

SEQ ID NO: 5880 - protein, 10 aa, Homo Sapiens
IVHRFGKQAP

SEQ ID NO: 5881 - protein, 10 aa, Homo Sapiens
GKQAPAYVHT

SEQ ID NO: 5882 - protein, 10 aa, Homo Sapiens
APAYVHTMIA

SEQ ID NO: 5883 - protein, 10 aa, Homo Sapiens
RRAVIKILHS

SEQ ID NO: 5884 - protein, 10 aa, Homo Sapiens
VTMLSIFWFN

SEQ ID NO: 5885 - protein, 10 aa, Homo Sapiens
SHMFFIKFFT

SEQ ID NO: 5886 - protein, 10 aa, Homo Sapiens
AFDRFVAVSN

SEQ ID NO: 5887 - protein, 10 aa, Homo Sapiens
NPLRYAMILT

SEQ ID NO: 5888 - protein, 10 aa, Homo Sapiens
LTDSRIAQIG

SEQ ID NO: 5889 - protein, 10 aa, Homo Sapiens
QVLHHSYCYH

SEQ ID NO: 5890 - protein, 10 aa, Homo Sapiens
YHPDVMKLSC

SEQ ID NO: 5891 - protein, 10 aa, Homo Sapiens
ASPEERKETF

SEQ ID NO: 5892 - protein, 10 aa, Homo Sapiens
LSIVHRFGKQ

SEQ ID NO: 5893 - protein, 10 aa, Homo Sapiens
VHRFGKQAPA

SEQ ID NO: 5894 - protein, 10 aa, Homo Sapiens
LSIFWFNVRE

SEQ ID NO: 5895 - protein, 10 aa, Homo Sapiens
WFNVREISFN

SEQ ID NO: 5896 - protein, 10 aa, Homo Sapiens
FNVREISFNA

SEQ ID NO: 5897 - protein, 10 aa, Homo Sapiens
LSHMFFIKFF

SEQ ID NO: 5898 - protein, 10 aa, Homo Sapiens
MFFIKFFTVM

SEQ ID NO: 5899 - protein, 10 aa, Homo Sapiens
FFIKFFTVME

SEQ ID NO: 5900 - protein, 10 aa, Homo Sapiens
LSYCHSQVLH

SEQ ID NO: 5901 - protein, 10 aa, Homo Sapiens
HSYCYHPDVM

SEQ ID NO: 5902 - protein, 10 aa, Homo Sapiens
HRFGKQAPAY

SEQ ID NO: 5903 - protein, 10 aa, Homo Sapiens
NPVIYSVKTK

SEQ ID NO: 5904 - protein, 10 aa, Homo Sapiens
FWFNVREISF

SEQ ID NO: 5905 - protein, 10 aa, Homo Sapiens
SFNACLSHMF

SEQ ID NO: 5906 - protein, 10 aa, Homo Sapiens
ACLSHMFFIK

SEQ ID NO: 5907 - protein, 10 aa, Homo Sapiens
IKFFTVMESS

SEQ ID NO: 5908 - protein, 10 aa, Homo Sapiens
SSVLLAMAFD

SEQ ID NO: 5909 - protein, 10 aa, Homo Sapiens
FDRFVAVSNP

SEQ ID NO: 5910 - protein, 10 aa, Homo Sapiens
RYAMILTDSR

SEQ ID NO: 5911 - protein, 10 aa, Homo Sapiens
NSAVGLTAMF

SEQ ID NO: 5912 - protein, 10 aa, Homo Sapiens
RTVLSVASPE

SEQ ID NO: 5913 - protein, 10 aa, Homo Sapiens
FSTCVSHIVA

SEQ ID NO: 5914 - protein, 10 aa, Homo Sapiens
SHIVAFAIYY

SEQ ID NO: 5915 - protein, 10 aa, Homo Sapiens
IPLISLSIVH

SEQ ID NO: 5916 - protein, 10 aa, Homo Sapiens
ISLSIVHRFG

SEQ ID NO: 5917 - protein, 10 aa, Homo Sapiens
ISPLMNPVIY

SEQ ID NO: 5918 - protein, 10 aa, Homo Sapiens
PVIYSVKTKQ

SEQ ID NO: 5919 - protein, 10 aa, Homo Sapiens
LSMLSATDLG

SEQ ID NO: 5920 - protein, 10 aa, Homo Sapiens
FNACLSHMFF

SEQ ID NO: 5921 - protein, 10 aa, Homo Sapiens
CHSQVLHHSY

SEQ ID NO: 5922 - protein, 10 aa, Homo Sapiens
SQVLHHSYCY

SEQ ID NO: 5923 - protein, 10 aa, Homo Sapiens
LHHSYCYHPD

SEQ ID NO: 5924 - protein, 10 aa, Homo Sapiens
SYCYHPDVMK

SEQ ID NO: 5925 - protein, 10 aa, Homo Sapiens
SPEERKETFS

SEQ ID NO: 5926 - protein, 10 aa, Homo Sapiens
KETFSTCVSH

SEQ ID NO: 5927 - protein, 10 aa, Homo Sapiens
VSHIVAFAIY

SEQ ID NO: 5928 - protein, 10 aa, Homo Sapiens
PAYVHTMIAN

SEQ ID NO: 5929 - protein, 10 aa, Homo Sapiens
TYLLISPLMN

SEQ ID NO: 5930 - protein, 10 aa, Homo Sapiens
IFWFNVREIS

SEQ ID NO: 5931 - protein, 10 aa, Homo Sapiens
REISFNACLS

SEQ ID NO: 5932 - protein, 10 aa, Homo Sapiens
LSCTDTRINS

SEQ ID NO: 5933 - protein, 10 aa, Homo Sapiens
LSVASPEERK

SEQ ID NO: 5934 - protein, 10 aa, Homo Sapiens
PEERKETFST

SEQ ID NO: 5935 - protein, 10 aa, Homo Sapiens
IYSVKTKQIR

SEQ ID NO: 5936 - protein, 10 aa, Homo Sapiens
YSVKTKQIRR

SEQ ID NO: 5937 - protein, 10 aa, Homo Sapiens
TKQIRRAVIK

SEQ ID NO: 5938 - protein, 10 aa, Homo Sapiens
IRRAVIKILH

SEQ ID NO: 5939 - protein, 10 aa, Homo Sapiens
RFVAVSNPLR

SEQ ID NO: 5940 - protein, 10 aa, Homo Sapiens
CYHPDVMKLS

SEQ ID NO: 5941 - protein, 10 aa, Homo Sapiens
TDTRINSAVG

SEQ ID NO: 5942 - protein, 10 aa, Homo Sapiens
FGKQAPAYVH

SEQ ID NO: 5943 - protein, 10 aa, Homo Sapiens
PDVMKLSCTD

SEQ ID NO: 5944 - protein, 10 aa, Homo Sapiens
EERKETFSTC

SEQ ID NO: 5945 - protein, 10 aa, Homo Sapiens
RKETFSTCVS

SEQ ID NO: 5946 - protein, 10 aa, Homo Sapiens
ESSVLLAMAF

SEQ ID NO: 5947 - protein, 10 aa, Homo Sapiens
AMAFDRFVAV

SEQ ID NO: 5948 - protein, 10 aa, Homo Sapiens
AFAIYYIPLI

SEQ ID NO: 5949 - protein, 10 aa, Homo Sapiens
APAYVHTMIA

SEQ ID NO: 5950 - protein, 10 aa, Homo Sapiens
LSATDLGLSI

SEQ ID NO: 5951 - protein, 10 aa, Homo Sapiens
FNACLSHMFF

SEQ ID NO: 5952 - protein, 10 aa, Homo Sapiens
LLAMAFDRFV

SEQ ID NO: 5953 - protein, 10 aa, Homo Sapiens
FVAVSNPLRY

SEQ ID NO: 5954 - protein, 10 aa, Homo Sapiens
RYAMILTDSR

SEQ ID NO: 5955 - protein, 10 aa, Homo Sapiens
RIAQIGVASV

SEQ ID NO: 5956 - protein, 10 aa, Homo Sapiens
GVASVIRGLL

SEQ ID NO: 5957 - protein, 10 aa, Homo Sapiens
MVALLIRLSY

SEQ ID NO: 5958 - protein, 10 aa, Homo Sapiens
NSAVGLTAMF

SEQ ID NO: 5959 - protein, 10 aa, Homo Sapiens
LTAMFSTVGV

SEQ ID NO: 5960 - protein, 10 aa, Homo Sapiens
SVASPEERKE

SEQ ID NO: 5961 - protein, 10 aa, Homo Sapiens
IVAFAIYYIP

SEQ ID NO: 5962 - protein, 10 aa, Homo Sapiens
KQAPAYVHTM

SEQ ID NO: 5963 - protein, 10 aa, Homo Sapiens
MIANTYLLIS

SEQ ID NO: 5964 - protein, 10 aa, Homo Sapiens
RRAVIKILHS

SEQ ID NO: 5965 - protein, 10 aa, Homo Sapiens
SATDLGLSIS

SEQ ID NO: 5966 - protein, 10 aa, Homo Sapiens
NACLSHMFFI

SEQ ID NO: 5967 - protein, 10 aa, Homo Sapiens
LAMAFDRFVA

SEQ ID NO: 5968 - protein, 10 aa, Homo Sapiens
MAFDRFVAVS

SEQ ID NO: 5969 - protein, 10 aa, Homo Sapiens
VAVSNPLRYA

SEQ ID NO: 5970 - protein, 10 aa, Homo Sapiens
YAMILTDSRI

SEQ ID NO: 5971 - protein, 10 aa, Homo Sapiens
IAQIGVASVI

SEQ ID NO: 5972 - protein, 10 aa, Homo Sapiens
VASVIRGLLM

SEQ ID NO: 5973 - protein, 10 aa, Homo Sapiens
VALLIRLSYC

SEQ ID NO: 5974 - protein, 10 aa, Homo Sapiens
SAVGLTAMFS

SEQ ID NO: 5975 - protein, 10 aa, Homo Sapiens
TAMFSTVGVD

SEQ ID NO: 5976 - protein, 10 aa, Homo Sapiens
VASPEERKET

SEQ ID NO: 5977 - protein, 10 aa, Homo Sapiens
VAFAIYYIPL

SEQ ID NO: 5978 - protein, 10 aa, Homo Sapiens
FAIYYIPLIS

SEQ ID NO: 5979 - protein, 10 aa, Homo Sapiens
QAPAYVHTMI

SEQ ID NO: 5980 - protein, 10 aa, Homo Sapiens
PAYVHTMIAN

SEQ ID NO: 5981 - protein, 10 aa, Homo Sapiens
IANTYLLISP

SEQ ID NO: 5982 - protein, 10 aa, Homo Sapiens
RAVIKILHSK

SEQ ID NO: 5983 - protein, 10 aa, Homo Sapiens
ATDLGLSIST

SEQ ID NO: 5984 - protein, 10 aa, Homo Sapiens
ACLSHMFFIK

SEQ ID NO: 5985 - protein, 10 aa, Homo Sapiens
AFDRFVAVSN

SEQ ID NO: 5986 - protein, 10 aa, Homo Sapiens
AVSNPLRYAM

SEQ ID NO: 5987 - protein, 10 aa, Homo Sapiens
AMILTDSRIA

SEQ ID NO: 5988 - protein, 10 aa, Homo Sapiens
AQIGVASVIR

SEQ ID NO: 5989 - protein, 10 aa, Homo Sapiens
ASVIRGLLML

SEQ ID NO: 5990 - protein, 10 aa, Homo Sapiens
ALLIRLSYCH

SEQ ID NO: 5991 - protein, 10 aa, Homo Sapiens
AVGLTAMFST

SEQ ID NO: 5992 - protein, 10 aa, Homo Sapiens
AMFSTVGVDL

SEQ ID NO: 5993 - protein, 10 aa, Homo Sapiens
ASPEERKETF

SEQ ID NO: 5994 - protein, 10 aa, Homo Sapiens
AIYYIPLISL

SEQ ID NO: 5995 - protein, 10 aa, Homo Sapiens
AYVHTMIANT

SEQ ID NO: 5996 - protein, 10 aa, Homo Sapiens
ANTYLLISPL

SEQ ID NO: 5997 - protein, 10 aa, Homo Sapiens
AVIKILHSKE

SEQ ID NO: 5998 - protein, 10 aa, Homo Sapiens
MESSVLLAMA

SEQ ID NO: 5999 - protein, 10 aa, Homo Sapiens
TCVSHIVAFA

SEQ ID NO: 6000 - protein, 10 aa, Homo Sapiens
VHRFGKQAPA

SEQ ID NO: 6001 - protein, 10 aa, Homo Sapiens
MYYFLSMLSA

SEQ ID NO: 6002 - protein, 10 aa, Homo Sapiens
FNVREISFNA

SEQ ID NO: 6003 - protein, 10 aa, Homo Sapiens
TVMESSVLLA

SEQ ID NO: 6004 - protein, 10 aa, Homo Sapiens
LAMAFDRFVA

SEQ ID NO: 6005 - protein, 10 aa, Homo Sapiens
VAVSNPLRYA

SEQ ID NO: 6006 - protein, 10 aa, Homo Sapiens
AMILTDSRIA

SEQ ID NO: 6007 - protein, 10 aa, Homo Sapiens
DSRIAQIGVA

SEQ ID NO: 6008 - protein, 10 aa, Homo Sapiens
GLLMLTPMVA

SEQ ID NO: 6009 - protein, 10 aa, Homo Sapiens
SCTDTRINSA

SEQ ID NO: 6010 - protein, 10 aa, Homo Sapiens
RINSAVGLTA

SEQ ID NO: 6011 - protein, 10 aa, Homo Sapiens
LIIRTVLSVA

SEQ ID NO: 6012 - protein, 10 aa, Homo Sapiens
FSTCVSHIVA

SEQ ID NO: 6013 - protein, 10 aa, Homo Sapiens
SIVHRFGKQA

SEQ ID NO: 6014 - protein, 10 aa, Homo Sapiens
APAYVHTMIA

SEQ ID NO: 6015 - protein, 10 aa, Homo Sapiens
SVKTKQIRRA

SEQ ID NO: 6016 - protein, 10 aa, Homo Sapiens
YYFLSMLSAT

SEQ ID NO: 6017 - protein, 10 aa, Homo Sapiens
NVREISFNAC

SEQ ID NO: 6018 - protein, 10 aa, Homo Sapiens
VMESSVLLAM

SEQ ID NO: 6019 - protein, 10 aa, Homo Sapiens
ESSVLLAMAF

SEQ ID NO: 6020 - protein, 10 aa, Homo Sapiens
AMAFDRFVAV

SEQ ID NO: 6021 - protein, 10 aa, Homo Sapiens
AVSNPLRYAM

SEQ ID NO: 6022 - protein, 10 aa, Homo Sapiens
MILTDSRIAQ

SEQ ID NO: 6023 - protein, 10 aa, Homo Sapiens
SRIAQIGVAS

SEQ ID NO: 6024 - protein, 10 aa, Homo Sapiens
LLMLTPMVAL

SEQ ID NO: 6025 - protein, 10 aa, Homo Sapiens
CTDTRINSAV

SEQ ID NO: 6026 - protein, 10 aa, Homo Sapiens
INSAVGLTAM

SEQ ID NO: 6027 - protein, 10 aa, Homo Sapiens
IIRTVLSVAS

SEQ ID NO: 6028 - protein, 10 aa, Homo Sapiens
STCVSHIVAF

SEQ ID NO: 6029 - protein, 10 aa, Homo Sapiens
CVSHIVAFAI

SEQ ID NO: 6030 - protein, 10 aa, Homo Sapiens
IVHRFGKQAP

SEQ ID NO: 6031 - protein, 10 aa, Homo Sapiens
HRFGKQAPAY

SEQ ID NO: 6032 - protein, 10 aa, Homo Sapiens
PAYVHTMIAN

SEQ ID NO: 6033 - protein, 10 aa, Homo Sapiens
VKTKQIRRAV

SEQ ID NO: 6034 - protein, 10 aa, Homo Sapiens
YFLSMLSATD

SEQ ID NO: 6035 - protein, 10 aa, Homo Sapiens
VREISFNACL

SEQ ID NO: 6036 - protein, 10 aa, Homo Sapiens
SSVLLAMAFD

SEQ ID NO: 6037 - protein, 10 aa, Homo Sapiens
MAFDRFVAVS

SEQ ID NO: 6038 - protein, 10 aa, Homo Sapiens
VSNPLRYAMI

SEQ ID NO: 6039 - protein, 10 aa, Homo Sapiens
ILTDSRIAQI

SEQ ID NO: 6040 - protein, 10 aa, Homo Sapiens
RIAQIGVASV

SEQ ID NO: 6041 - protein, 10 aa, Homo Sapiens
LMLTPMVALL

SEQ ID NO: 6042 - protein, 10 aa, Homo Sapiens
TDTRINSAVG

SEQ ID NO: 6043 - protein, 10 aa, Homo Sapiens
NSAVGLTAMF

SEQ ID NO: 6044 - protein, 10 aa, Homo Sapiens
IRTVLSVASP

SEQ ID NO: 6045 - protein, 10 aa, Homo Sapiens
VSHIVAFAIY

SEQ ID NO: 6046 - protein, 10 aa, Homo Sapiens
RFGKQAPAYV

SEQ ID NO: 6047 - protein, 10 aa, Homo Sapiens
AYVHTMIANT

SEQ ID NO: 6048 - protein, 10 aa, Homo Sapiens
KTKQIRRAVI

SEQ ID NO: 6049 - protein, 10 aa, Homo Sapiens
VSHIVAFAIY

SEQ ID NO: 6050 - protein, 10 aa, Homo Sapiens
FVAVSNPLRY

SEQ ID NO: 6051 - protein, 10 aa, Homo Sapiens
MVALLIRLSY

SEQ ID NO: 6052 - protein, 10 aa, Homo Sapiens
VDLLLILLSY

SEQ ID NO: 6053 - protein, 10 aa, Homo Sapiens
ATDLGLSIST

SEQ ID NO: 6054 - protein, 10 aa, Homo Sapiens
SHIVAFAIYY

SEQ ID NO: 6055 - protein, 10 aa, Homo Sapiens
ISPLMNPVIY

SEQ ID NO: 6056 - protein, 10 aa, Homo Sapiens
GVDLLLILLS

SEQ ID NO: 6057 - protein, 10 aa, Homo Sapiens
VMESSVLLAM

SEQ ID NO: 6058 - protein, 10 aa, Homo Sapiens
SQVLHHSYCY

SEQ ID NO: 6059 - protein, 10 aa, Homo Sapiens
CTDTRINSAV

SEQ ID NO: 6060 - protein, 10 aa, Homo Sapiens
STVGVDLLLI

SEQ ID NO: 6061 - protein, 10 aa, Homo Sapiens
YVHTMIANTY

SEQ ID NO: 6062 - protein, 10 aa, Homo Sapiens
LTDSRIAQIG

SEQ ID NO: 6063 - protein, 10 aa, Homo Sapiens
HRFGKQAPAY

SEQ ID NO: 6064 - protein, 10 aa, Homo Sapiens
CHSQVLHHSY

SEQ ID NO: 6065 - protein, 10 aa, Homo Sapiens
MLTPMVALLI

SEQ ID NO: 6066 - protein, 10 aa, Homo Sapiens
FSTVGVDLLL

SEQ ID NO: 6067 - protein, 10 aa, Homo Sapiens
VREISFNACL

SEQ ID NO: 6068 - protein, 10 aa, Homo Sapiens
ASVIRGLLML

SEQ ID NO: 6069 - protein, 10 aa, Homo Sapiens
LTPMVALLIR

SEQ ID NO: 6070 - protein, 10 aa, Homo Sapiens
SPEERKETFS

SEQ ID NO: 6071 - protein, 10 aa, Homo Sapiens
YYIPLISLSI

SEQ ID NO: 6072 - protein, 10 aa, Homo Sapiens
LSATDLGLSI

SEQ ID NO: 6073 - protein, 10 aa, Homo Sapiens
AFDRFVAVSN

SEQ ID NO: 6074 - protein, 10 aa, Homo Sapiens
RKETFSTCVS

SEQ ID NO: 6075 - protein, 10 aa, Homo Sapiens
ISTLVTMLSI

SEQ ID NO: 6076 - protein, 10 aa, Homo Sapiens
VTMLSIFWFN

SEQ ID NO: 6077 - protein, 10 aa, Homo Sapiens
CLSHMFFIKF

SEQ ID NO: 6078 - protein, 10 aa, Homo Sapiens
VSNPLRYAMI

SEQ ID NO: 6079 - protein, 10 aa, Homo Sapiens
VASVIRGLLM

SEQ ID NO: 6080 - protein, 10 aa, Homo Sapiens
HPDVMKLSCT

SEQ ID NO: 6081 - protein, 10 aa, Homo Sapiens
PEERKETFST

SEQ ID NO: 6082 - protein, 10 aa, Homo Sapiens
FSTCVSHIVA

SEQ ID NO: 6083 - protein, 10 aa, Homo Sapiens
YSVKTKQIRR

SEQ ID NO: 6084 - protein, 10 aa, Homo Sapiens
FTVMESSVLL

SEQ ID NO: 6085 - protein, 10 aa, Homo Sapiens
TVMESSVLLA

SEQ ID NO: 6086 - protein, 10 aa, Homo Sapiens
SYCHSQVLHH

SEQ ID NO: 6087 - protein, 10 aa, Homo Sapiens
LSCTDTRINS

SEQ ID NO: 6088 - protein, 10 aa, Homo Sapiens
VLIIRTVLSV

SEQ ID NO: 6089 - protein, 10 aa, Homo Sapiens
LSIVHRFGKQ

SEQ ID NO: 6090 - protein, 10 aa, Homo Sapiens
SMLSATDLGL

SEQ ID NO: 6091 - protein, 10 aa, Homo Sapiens
STLVTMLSIF

SEQ ID NO: 6092 - protein, 10 aa, Homo Sapiens
VIRGLLMLTP

SEQ ID NO: 6093 - protein, 10 aa, Homo Sapiens
YHPDVMKLSC

SEQ ID NO: 6094 - protein, 10 aa, Homo Sapiens
STCVSHIVAF

SEQ ID NO: 6095 - protein, 10 aa, Homo Sapiens
HTMIANTYLL

SEQ ID NO: 6096 - protein, 10 aa, Homo Sapiens
TMIANTYLLI

SEQ ID NO: 6097 - protein, 10 aa, Homo Sapiens
NTYLLISPLM

SEQ ID NO: 6098 - protein, 10 aa, Homo Sapiens
KTKQIRRAVI

SEQ ID NO: 6099 - protein, 10 aa, Homo Sapiens
LGLSISTLVT

SEQ ID NO: 6100 - protein, 10 aa, Homo Sapiens
PLRYAMILTD

SEQ ID NO: 6101 - protein, 10 aa, Homo Sapiens
RINSAVGLTA

SEQ ID NO: 6102 - protein, 10 aa, Homo Sapiens
VGVDLLLILL

SEQ ID NO: 6103 - protein, 10 aa, Homo Sapiens
LILLSYVLII

SEQ ID NO: 6104 - protein, 10 aa, Homo Sapiens
ETFSTCVSHI

SEQ ID NO: 6105 - protein, 10 aa, Homo Sapiens
FAIYYIPLIS

SEQ ID NO: 6106 - protein, 10 aa, Homo Sapiens
TYLLISPLMN

SEQ ID NO: 6107 - protein, 10 aa, Homo Sapiens
SPLMNPVIYS

SEQ ID NO: 6108 - protein, 10 aa, Homo Sapiens
KQIRRAVIKI

SEQ ID NO: 6109 - protein, 10 aa, Homo Sapiens
MYYFLSMLSA

SEQ ID NO: 6110 - protein, 10 aa, Homo Sapiens
LSMLSATDLG

SEQ ID NO: 6111 - protein, 10 aa, Homo Sapiens
LSISTLVTML

SEQ ID NO: 6112 - protein, 10 aa, Homo Sapiens
EISFNACLSH

SEQ ID NO: 6113 - protein, 10 aa, Homo Sapiens
SSVLLAMAFD

SEQ ID NO: 6114 - protein, 10 aa, Homo Sapiens
NPLRYAMILT

SEQ ID NO: 6115 - protein, 10 aa, Homo Sapiens
LSYCHSQVLH

SEQ ID NO: 6116 - protein, 10 aa, Homo Sapiens
CYHPDVMKLS

SEQ ID NO: 6117 - protein, 10 aa, Homo Sapiens
DTRINSAVGL

SEQ ID NO: 6118 - protein, 10 aa, Homo Sapiens
LTAMFSTVGV

SEQ ID NO: 6119 - protein, 10 aa, Homo Sapiens
TVGVDLLLIL

SEQ ID NO: 6120 - protein, 10 aa, Homo Sapiens
RTVLSVASPE

SEQ ID NO: 6121 - protein, 10 aa, Homo Sapiens
VASPEERKET

SEQ ID NO: 6122 - protein, 10 aa, Homo Sapiens
MIANTYLLIS

SEQ ID NO: 6123 - protein, 10 aa, Homo Sapiens
LISPLMNPVI

SEQ ID NO: 6124 - protein, 10 aa, Homo Sapiens
IRRAVIKILH

SEQ ID NO: 6125 - protein, 10 aa, Homo Sapiens
RRAVIKILHS

SEQ ID NO: 6126 - protein, 10 aa, Homo Sapiens
TLVTMLSIFW

SEQ ID NO: 6127 - protein, 10 aa, Homo Sapiens
MLSIFWFNVR

SEQ ID NO: 6128 - protein, 10 aa, Homo Sapiens
LSIFWFNVRE

SEQ ID NO: 6129 - protein, 10 aa, Homo Sapiens
FWFNVREISF

SEQ ID NO: 6130 - protein, 10 aa, Homo Sapiens
VLLAMAFDRF

SEQ ID NO: 6131 - protein, 10 aa, Homo Sapiens
MILTDSRIAQ

SEQ ID NO: 6132 - protein, 10 aa, Homo Sapiens
DSRIAQIGVA

SEQ ID NO: 6133 - protein, 10 aa, Homo Sapiens
QIGVASVIRG

SEQ ID NO: 6134 - protein, 10 aa, Homo Sapiens
HSYCYHPDVM

SEQ ID NO: 6135 - protein, 10 aa, Homo Sapiens
YCYHPDVMKL

SEQ ID NO: 6136 - protein, 10 aa, Homo Sapiens
NSAVGLTAMF

SEQ ID NO: 6137 - protein, 10 aa, Homo Sapiens
ILLSYVLIIR

SEQ ID NO: 6138 - protein, 10 aa, Homo Sapiens
LLSYVLIIRT

SEQ ID NO: 6139 - protein, 10 aa, Homo Sapiens
ASPEERKETF

SEQ ID NO: 6140 - protein, 10 aa, Homo Sapiens
VAFAIYYIPL

SEQ ID NO: 6141 - protein, 10 aa, Homo Sapiens
AIYYIPLISL

SEQ ID NO: 6142 - protein, 10 aa, Homo Sapiens
IPLISLSIVH

SEQ ID NO: 6143 - protein, 10 aa, Homo Sapiens
KQAPAYVHTM

SEQ ID NO: 6144 - protein, 10 aa, Homo Sapiens
LMNPVIYSVK

SEQ ID NO: 6145 - protein, 10 aa, Homo Sapiens
SISTLVTMLS

SEQ ID NO: 6146 - protein, 10 aa, Homo Sapiens
ISFNACLSHM

SEQ ID NO: 6147 - protein, 10 aa, Homo Sapiens
ACLSHMFFIK

SEQ ID NO: 6148 - protein, 10 aa, Homo Sapiens
LSHMFFIKFF

SEQ ID NO: 6149 - protein, 10 aa, Homo Sapiens
MFFIKFFTVM

SEQ ID NO: 6150 - protein, 10 aa, Homo Sapiens
ESSVLLAMAF

SEQ ID NO: 6151 - protein, 10 aa, Homo Sapiens
AMAFDRFVAV

SEQ ID NO: 6152 - protein, 10 aa, Homo Sapiens
TDSRIAQIGV

SEQ ID NO: 6153 - protein, 10 aa, Homo Sapiens
SVIRGLLMLT

SEQ ID NO: 6154 - protein, 10 aa, Homo Sapiens
TPMVALLIRL

SEQ ID NO: 6155 - protein, 10 aa, Homo Sapiens
HSQVLHHSYC

SEQ ID NO: 6156 - protein, 10 aa, Homo Sapiens
VGLTAMFSTV

SEQ ID NO: 6157 - protein, 10 aa, Homo Sapiens
LSYVLIIRTV

SEQ ID NO: 6158 - protein, 10 aa, Homo Sapiens
SYVLIIRTVL

SEQ ID NO: 6159 - protein, 10 aa, Homo Sapiens
YVLIIRTVLS

SEQ ID NO: 6160 - protein, 10 aa, Homo Sapiens
LSVASPEERK

SEQ ID NO: 6161 - protein, 10 aa, Homo Sapiens
SVASPEERKE

SEQ ID NO: 6162 - protein, 10 aa, Homo Sapiens
ISLSIVHRFG

SEQ ID NO: 6163 - protein, 10 aa, Homo Sapiens
SLSIVHRFGK

SEQ ID NO: 6164 - protein, 10 aa, Homo Sapiens
PAYVHTMIAN

SEQ ID NO: 6165 - protein, 10 aa, Homo Sapiens
IANTYLLISP

SEQ ID NO: 6166 - protein, 10 aa, Homo Sapiens
MLSATDLGLS

SEQ ID NO: 6167 - protein, 10 aa, Homo Sapiens
DLGLSISTLV

SEQ ID NO: 6168 - protein, 10 aa, Homo Sapiens
SIFWFNVREI

SEQ ID NO: 6169 - protein, 10 aa, Homo Sapiens
NVREISFNAC

SEQ ID NO: 6170 - protein, 10 aa, Homo Sapiens
SFNACLSHMF

SEQ ID NO: 6171 - protein, 10 aa, Homo Sapiens
HMFFIKFFTV

SEQ ID NO: 6172 - protein, 10 aa, Homo Sapiens
RFVAVSNPLR

SEQ ID NO: 6173 - protein, 10 aa, Homo Sapiens
SRIAQIGVAS

SEQ ID NO: 6174 - protein, 10 aa, Homo Sapiens
GVASVIRGLL

SEQ ID NO: 6175 - protein, 10 aa, Homo Sapiens
LMLTPMVALL

SEQ ID NO: 6176 - protein, 10 aa, Homo Sapiens
SYCYHPDVMK

SEQ ID NO: 6177 - protein, 10 aa, Homo Sapiens
TRINSAVGLT

SEQ ID NO: 6178 - protein, 10 aa, Homo Sapiens
SAVGLTAMFS

SEQ ID NO: 6179 - protein, 10 aa, Homo Sapiens
MFSTVGVDLL

SEQ ID NO: 6180 - protein, 10 aa, Homo Sapiens
LLILLSYVLI

SEQ ID NO: 6181 - protein, 10 aa, Homo Sapiens
EERKETFSTC

SEQ ID NO: 6182 - protein, 10 aa, Homo Sapiens
AFAIYYIPLI

SEQ ID NO: 6183 - protein, 10 aa, Homo Sapiens
SIVHRFGKQA

SEQ ID NO: 6184 - protein, 10 aa, Homo Sapiens
YLLISPLMNP

SEQ ID NO: 6185 - protein, 10 aa, Homo Sapiens
AVIKILHSKE

SEQ ID NO: 6186 - protein, 10 aa, Homo Sapiens
YYFLSMLSAT

SEQ ID NO: 6187 - protein, 10 aa, Homo Sapiens
YFLSMLSATD

SEQ ID NO: 6188 - protein, 10 aa, Homo Sapiens
FLSMLSATDL

SEQ ID NO: 6189 - protein, 10 aa, Homo Sapiens
SATDLGLSIS

SEQ ID NO: 6190 - protein, 10 aa, Homo Sapiens
REISFNACLS

SEQ ID NO: 6191 - protein, 10 aa, Homo Sapiens
SHMFFIKFFT

SEQ ID NO: 6192 - protein, 10 aa, Homo Sapiens
FFIKFFTVME

SEQ ID NO: 6193 - protein, 10 aa, Homo Sapiens
FIKFFTVMES

SEQ ID NO: 6194 - protein, 10 aa, Homo Sapiens
FFTVMESSVL

SEQ ID NO: 6195 - protein, 10 aa, Homo Sapiens
SVLLAMAFDR

SEQ ID NO: 6196 - protein, 10 aa, Homo Sapiens
LAMAFDRFVA

SEQ ID NO: 6197 - protein, 10 aa, Homo Sapiens
MAFDRFVAVS

SEQ ID NO: 6198 - protein, 10 aa, Homo Sapiens
FDRFVAVSNP

SEQ ID NO: 6199 - protein, 10 aa, Homo Sapiens
AVSNPLRYAM

SEQ ID NO: 6200 - protein, 10 aa, Homo Sapiens
SNPLRYAMIL

SEQ ID NO: 6201 - protein, 10 aa, Homo Sapiens
YAMILTDSRI

SEQ ID NO: 6202 - protein, 10 aa, Homo Sapiens
AQIGVASVIR

SEQ ID NO: 6203 - protein, 10 aa, Homo Sapiens
GLLMLTPMVA

SEQ ID NO: 6204 - protein, 10 aa, Homo Sapiens
PMVALLIRLS

SEQ ID NO: 6205 - protein, 10 aa, Homo Sapiens
ALLIRLSYCH

SEQ ID NO: 6206 - protein, 10 aa, Homo Sapiens
RLSYCHSQVL

SEQ ID NO: 6207 - protein, 10 aa, Homo Sapiens
YCHSQVLHHS

SEQ ID NO: 6208 - protein, 10 aa, Homo Sapiens
VLHHSYCYHP

SEQ ID NO: 6209 - protein, 10 aa, Homo Sapiens
SCTDTRINSA

SEQ ID NO: 6210 - protein, 10 aa, Homo Sapiens
GLTAMFSTVG

SEQ ID NO: 6211 - protein, 10 aa, Homo Sapiens
TAMFSTVGVD

SEQ ID NO: 6212 - protein, 10 aa, Homo Sapiens
AMFSTVGVDL

SEQ ID NO: 6213 - protein, 10 aa, Homo Sapiens
LLLILLSYVL

SEQ ID NO: 6214 - protein, 10 aa, Homo Sapiens
VLSVASPEER

SEQ ID NO: 6215 - protein, 10 aa, Homo Sapiens
IYYIPLISLS

SEQ ID NO: 6216 - protein, 10 aa, Homo Sapiens
YIPLISLSIV

SEQ ID NO: 6217 - protein, 10 aa, Homo Sapiens
FGKQAPAYVH

SEQ ID NO: 6218 - protein, 10 aa, Homo Sapiens
VHTMIANTYL

SEQ ID NO: 6219 - protein, 10 aa, Homo Sapiens
MNPVIYSVKT

SEQ ID NO: 6220 - protein, 10 aa, Homo Sapiens
PVIYSVKTKQ

SEQ ID NO: 6221 - protein, 10 aa, Homo Sapiens
SVKTKQIRRA

SEQ ID NO: 6222 - protein, 10 aa, Homo Sapiens
VKTKQIRRAV

SEQ ID NO: 6223 - protein, 10 aa, Homo Sapiens
TDLGLSISTL

SEQ ID NO: 6224 - protein, 10 aa, Homo Sapiens
GLSISTLVTM

SEQ ID NO: 6225 - protein, 10 aa, Homo Sapiens
IFWFNVREIS

SEQ ID NO: 6226 - protein, 10 aa, Homo Sapiens
FNVREISFNA

SEQ ID NO: 6227 - protein, 10 aa, Homo Sapiens
FNACLSHMFF

SEQ ID NO: 6228 - protein, 10 aa, Homo Sapiens
MESSVLLAMA

SEQ ID NO: 6229 - protein, 10 aa, Homo Sapiens
LLAMAFDRFV

SEQ ID NO: 6230 - protein, 10 aa, Homo Sapiens
VAVSNPLRYA

SEQ ID NO: 6231 - protein, 10 aa, Homo Sapiens
AMILTDSRIA

SEQ ID NO: 6232 - protein, 10 aa, Homo Sapiens
ILTDSRIAQI

SEQ ID NO: 6233 - protein, 10 aa, Homo Sapiens
RIAQIGVASV

SEQ ID NO: 6234 - protein, 10 aa, Homo Sapiens
IAQIGVASVI

SEQ ID NO: 6235 - protein, 10 aa, Homo Sapiens
RGLLMLTPMV

SEQ ID NO: 6236 - protein, 10 aa, Homo Sapiens
LLMLTPMVAL

SEQ ID NO: 6237 - protein, 10 aa, Homo Sapiens
VALLIRLSYC

SEQ ID NO: 6238 - protein, 10 aa, Homo Sapiens
LLIRLSYCHS

SEQ ID NO: 6239 - protein, 10 aa, Homo Sapiens
VMKLSCTDTR

SEQ ID NO: 6240 - protein, 10 aa, Homo Sapiens
KLSCTDTRIN

SEQ ID NO: 6241 - protein, 10 aa, Homo Sapiens
TDTRINSAVG

SEQ ID NO: 6242 - protein, 10 aa, Homo Sapiens
AVGLTAMFST

SEQ ID NO: 6243 - protein, 10 aa, Homo Sapiens
DLLLILLSYV

SEQ ID NO: 6244 - protein, 10 aa, Homo Sapiens
LIIRTVLSVA

SEQ ID NO: 6245 - protein, 10 aa, Homo Sapiens
IRTVLSVASP

SEQ ID NO: 6246 - protein, 10 aa, Homo Sapiens
TCVSHIVAFA

SEQ ID NO: 6247 - protein, 10 aa, Homo Sapiens
PLISLSIVHR

SEQ ID NO: 6248 - protein, 10 aa, Homo Sapiens
LISLSIVHRF

SEQ ID NO: 6249 - protein, 10 aa, Homo Sapiens
VHRFGKQAPA

SEQ ID NO: 6250 - protein, 10 aa, Homo Sapiens
QAPAYVHTMI

SEQ ID NO: 6251 - protein, 10 aa, Homo Sapiens
APAYVHTMIA

SEQ ID NO: 6252 - protein, 10 aa, Homo Sapiens
AYVHTMIANT

SEQ ID NO: 6253 - protein, 10 aa, Homo Sapiens
ANTYLLISPL

SEQ ID NO: 6254 - protein, 10 aa, Homo Sapiens
LLISPLMNPV

SEQ ID NO: 6255 - protein, 10 aa, Homo Sapiens
PLMNPVIYSV

SEQ ID NO: 6256 - protein, 10 aa, Homo Sapiens
NPVIYSVKTK

SEQ ID NO: 6257 - protein, 10 aa, Homo Sapiens
VIYSVKTKQI

SEQ ID NO: 6258 - protein, 10 aa, Homo Sapiens
VIKILHSKET

SEQ ID NO: 6259 - protein, 10 aa, Homo Sapiens
DTRINSAVGL

SEQ ID NO: 6260 - protein, 10 aa, Homo Sapiens
STCVSHIVAF

SEQ ID NO: 6261 - protein, 10 aa, Homo Sapiens
STLVTMLSIF

SEQ ID NO: 6262 - protein, 10 aa, Homo Sapiens
ETFSTCVSHI

SEQ ID NO: 6263 - protein, 10 aa, Homo Sapiens
LISLSIVHRF

SEQ ID NO: 6264 - protein, 10 aa, Homo Sapiens
LVTMLSIFWF

SEQ ID NO: 6265 - protein, 10 aa, Homo Sapiens
CLSHMFFIKF

SEQ ID NO: 6266 - protein, 10 aa, Homo Sapiens
VLLAMAFDRF

SEQ ID NO: 6267 - protein, 10 aa, Homo Sapiens
AIYYIPLISL

SEQ ID NO: 6268 - protein, 10 aa, Homo Sapiens
FVAVSNPLRY

SEQ ID NO: 6269 - protein, 10 aa, Homo Sapiens
LLMLTPMVAL

SEQ ID NO: 6270 - protein, 10 aa, Homo Sapiens
MVALLIRLSY

SEQ ID NO: 6271 - protein, 10 aa, Homo Sapiens
TVGVDLLLIL

SEQ ID NO: 6272 - protein, 10 aa, Homo Sapiens
QIRRAVIKIL

SEQ ID NO: 6273 - protein, 10 aa, Homo Sapiens
GLSISTLVTM

SEQ ID NO: 6274 - protein, 10 aa, Homo Sapiens
MFFIKFFTVM

SEQ ID NO: 6275 - protein, 10 aa, Homo Sapiens
GVASVIRGLL

SEQ ID NO: 6276 - protein, 10 aa, Homo Sapiens
YVHTMIANTY

SEQ ID NO: 6277 - protein, 10 aa, Homo Sapiens
FTVMESSVLL

SEQ ID NO: 6278 - protein, 10 aa, Homo Sapiens
AVSNPLRYAM

SEQ ID NO: 6279 - protein, 10 aa, Homo Sapiens
DLLLILLSYV

SEQ ID NO: 6280 - protein, 10 aa, Homo Sapiens
NTYLLISPLM

SEQ ID NO: 6281 - protein, 10 aa, Homo Sapiens
ESSVLLAMAF

SEQ ID NO: 6282 - protein, 10 aa, Homo Sapiens
RIAQIGVASV

SEQ ID NO: 6283 - protein, 10 aa, Homo Sapiens
MFSTVGVDLL

SEQ ID NO: 6284 - protein, 10 aa, Homo Sapiens
HTMIANTYLL

SEQ ID NO: 6285 - protein, 10 aa, Homo Sapiens
SIFWFNVREI

SEQ ID NO: 6286 - protein, 10 aa, Homo Sapiens
NVREISFNAC

SEQ ID NO: 6287 - protein, 10 aa, Homo Sapiens
EISFNACLSH

SEQ ID NO: 6288 - protein, 10 aa, Homo Sapiens
SFNACLSHMF

SEQ ID NO: 6289 - protein, 10 aa, Homo Sapiens
FIKFFTVMES

SEQ ID NO: 6290 - protein, 10 aa, Homo Sapiens
SVIRGLLMLT

SEQ ID NO: 6291 - protein, 10 aa, Homo Sapiens
RLSYCHSQVL

SEQ ID NO: 6292 - protein, 10 aa, Homo Sapiens
DVMKLSCTDT

SEQ ID NO: 6293 - protein, 10 aa, Homo Sapiens
LIIRTVLSVA

SEQ ID NO: 6294 - protein, 10 aa, Homo Sapiens
PLISLSIVHR

SEQ ID NO: 6295 - protein, 10 aa, Homo Sapiens
FLSMLSATDL

SEQ ID NO: 6296 - protein, 10 aa, Homo Sapiens
LSISTLVTML

SEQ ID NO: 6297 - protein, 10 aa, Homo Sapiens
ISFNACLSHM

SEQ ID NO: 6298 - protein, 10 aa, Homo Sapiens
TVMESSVLLA

SEQ ID NO: 6299 - protein, 10 aa, Homo Sapiens
DRFVAVSNPL

SEQ ID NO: 6300 - protein, 10 aa, Homo Sapiens
VIRGLLMLTP

SEQ ID NO: 6301 - protein, 10 aa, Homo Sapiens
STVGVDLLLI

SEQ ID NO: 6302 - protein, 10 aa, Homo Sapiens
LLLILLSYVL

SEQ ID NO: 6303 - protein, 10 aa, Homo Sapiens
YIPLISLSIV

SEQ ID NO: 6304 - protein, 10 aa, Homo Sapiens
HRFGKQAPAY

SEQ ID NO: 6305 - protein, 10 aa, Homo Sapiens
SVKTKQIRRA

SEQ ID NO: 6306 - protein, 10 aa, Homo Sapiens
TDLGLSISTL

SEQ ID NO: 6307 - protein, 10 aa, Homo Sapiens
FFTVMESSVL

SEQ ID NO: 6308 - protein, 10 aa, Homo Sapiens
ILTDSRIAQI

SEQ ID NO: 6309 - protein, 10 aa, Homo Sapiens
QIGVASVIRG

SEQ ID NO: 6310 - protein, 10 aa, Homo Sapiens
LTPMVALLIR

SEQ ID NO: 6311 - protein, 10 aa, Homo Sapiens
LLIRLSYCHS

SEQ ID NO: 6312 - protein, 10 aa, Homo Sapiens
AVGLTAMFST

SEQ ID NO: 6313 - protein, 10 aa, Homo Sapiens
GVDLLLILLS

SEQ ID NO: 6314 - protein, 10 aa, Homo Sapiens
VDLLLILLSY

SEQ ID NO: 6315 - protein, 10 aa, Homo Sapiens
LLILLSYVLI

SEQ ID NO: 6316 - protein, 10 aa, Homo Sapiens
VLIIRTVLSV

SEQ ID NO: 6317 - protein, 10 aa, Homo Sapiens
VSHIVAFAIY

SEQ ID NO: 6318 - protein, 10 aa, Homo Sapiens
IVAFAIYYIP

SEQ ID NO: 6319 - protein, 10 aa, Homo Sapiens
KQAPAYVHTM

SEQ ID NO: 6320 - protein, 10 aa, Homo Sapiens
MIANTYLLIS

SEQ ID NO: 6321 - protein, 10 aa, Homo Sapiens
LLISPLMNPV

SEQ ID NO: 6322 - protein, 10 aa, Homo Sapiens
AVIKILHSKE

SEQ ID NO: 6323 - protein, 10 aa, Homo Sapiens
DLGLSISTLV

SEQ ID NO: 6324 - protein, 10 aa, Homo Sapiens
VTMLSIFWFN

SEQ ID NO: 6325 - protein, 10 aa, Homo Sapiens
LSHMFFIKFF

SEQ ID NO: 6326 - protein, 10 aa, Homo Sapiens
VMESSVLLAM

SEQ ID NO: 6327 - protein, 10 aa, Homo Sapiens
QVLHHSYCYH

SEQ ID NO: 6328 - protein, 10 aa, Homo Sapiens
YCYHPDVMKL

SEQ ID NO: 6329 - protein, 10 aa, Homo Sapiens
LILLSYVLII

SEQ ID NO: 6330 - protein, 10 aa, Homo Sapiens
HIVAFAIYYI

SEQ ID NO: 6331 - protein, 10 aa, Homo Sapiens
VAFAIYYIPL

SEQ ID NO: 6332 - protein, 10 aa, Homo Sapiens
YLLISPLMNP

SEQ ID NO: 6333 - protein, 10 aa, Homo Sapiens
FWFNVREISF

SEQ ID NO: 6334 - protein, 10 aa, Homo Sapiens
LTDSRIAQIG

SEQ ID NO: 6335 - protein, 10 aa, Homo Sapiens
IGVASVIRGL

SEQ ID NO: 6336 - protein, 10 aa, Homo Sapiens
ASVIRGLLML

SEQ ID NO: 6337 - protein, 10 aa, Homo Sapiens
LMLTPMVALL

SEQ ID NO: 6338 - protein, 10 aa, Homo Sapiens
TPMVALLIRL

SEQ ID NO: 6339 - protein, 10 aa, Homo Sapiens
CTDTRINSAV

SEQ ID NO: 6340 - protein, 10 aa, Homo Sapiens
INSAVGLTAM

SEQ ID NO: 6341 - protein, 10 aa, Homo Sapiens
NSAVGLTAMF

SEQ ID NO: 6342 - protein, 10 aa, Homo Sapiens
LTAMFSTVGV

SEQ ID NO: 6343 - protein, 10 aa, Homo Sapiens
VGVDLLLILL

SEQ ID NO: 6344 - protein, 10 aa, Homo Sapiens
ILLSYVLIIR

SEQ ID NO: 6345 - protein, 10 aa, Homo Sapiens
LLSYVLIIRT

SEQ ID NO: 6346 - protein, 10 aa, Homo Sapiens
TVLSVASPEE

SEQ ID NO: 6347 - protein, 10 aa, Homo Sapiens
SVASPEERKE

SEQ ID NO: 6348 - protein, 10 aa, Homo Sapiens
ASPEERKETF

SEQ ID NO: 6349 - protein, 10 aa, Homo Sapiens
ANTYLLISPL

SEQ ID NO: 6350 - protein, 10 aa, Homo Sapiens
LISPLMNPVI

SEQ ID NO: 6351 - protein, 10 aa, Homo Sapiens
PLMNPVIYSV

SEQ ID NO: 6352 - protein, 10 aa, Homo Sapiens
PVIYSVKTKQ

SEQ ID NO: 6353 - protein, 10 aa, Homo Sapiens
KTKQIRRAVI

SEQ ID NO: 6354 - protein, 10 aa, Homo Sapiens
MLSATDLGLS

SEQ ID NO: 6355 - protein, 10 aa, Homo Sapiens
ATDLGLSIST

SEQ ID NO: 6356 - protein, 10 aa, Homo Sapiens
MLSIFWFNVR

SEQ ID NO: 6357 - protein, 10 aa, Homo Sapiens
FNACLSHMFF

SEQ ID NO: 6358 - protein, 10 aa, Homo Sapiens
PLRYAMILTD

SEQ ID NO: 6359 - protein, 10 aa, Homo Sapiens
IRGLLMLTPM

SEQ ID NO: 6360 - protein, 10 aa, Homo Sapiens
CHSQVLHHSY

SEQ ID NO: 6361 - protein, 10 aa, Homo Sapiens
AMFSTVGVDL

SEQ ID NO: 6362 - protein, 10 aa, Homo Sapiens
IIRTVLSVAS

SEQ ID NO: 6363 - protein, 10 aa, Homo Sapiens
EERKETFSTC

SEQ ID NO: 6364 - protein, 10 aa, Homo Sapiens
SHIVAFAIYY

SEQ ID NO: 6365 - protein, 10 aa, Homo Sapiens
AFAIYYIPLI

SEQ ID NO: 6366 - protein, 10 aa, Homo Sapiens
IVHRFGKQAP

SEQ ID NO: 6367 - protein, 10 aa, Homo Sapiens
ISPLMNPVIY

SEQ ID NO: 6368 - protein, 10 aa, Homo Sapiens
VIYSVKTKQI

SEQ ID NO: 6369 - protein, 10 aa, Homo Sapiens
VIKILHSKET

SEQ ID NO: 6370 - protein, 10 aa, Homo Sapiens
SISTLVTMLS

SEQ ID NO: 6371 - protein, 10 aa, Homo Sapiens
WFNVREISFN

SEQ ID NO: 6372 - protein, 10 aa, Homo Sapiens
FFIKFFTVME

SEQ ID NO: 6373 - protein, 10 aa, Homo Sapiens
MILTDSRIAQ

SEQ ID NO: 6374 - protein, 10 aa, Homo Sapiens
LIRLSYCHSQ

SEQ ID NO: 6375 - protein, 10 aa, Homo Sapiens
RINSAVGLTA

SEQ ID NO: 6376 - protein, 10 aa, Homo Sapiens
YVLIIRTVLS

SEQ ID NO: 6377 - protein, 10 aa, Homo Sapiens
RTVLSVASPE

SEQ ID NO: 6378 - protein, 10 aa, Homo Sapiens
CVSHIVAFAI

SEQ ID NO: 6379 - protein, 10 aa, Homo Sapiens
SIVHRFGKQA

SEQ ID NO: 6380 - protein, 10 aa, Homo Sapiens
SMLSATDLGL

SEQ ID NO: 6381 - protein, 10 aa, Homo Sapiens
KFFTVMESSV

SEQ ID NO: 6382 - protein, 10 aa, Homo Sapiens
SVLLAMAFDR

SEQ ID NO: 6383 - protein, 10 aa, Homo Sapiens
SNPLRYAMIL

SEQ ID NO: 6384 - protein, 10 aa, Homo Sapiens
DSRIAQIGVA

SEQ ID NO: 6385 - protein, 10 aa, Homo Sapiens
MLTPMVALLI

SEQ ID NO: 6386 - protein, 10 aa, Homo Sapiens
SQVLHHSYCY

SEQ ID NO: 6387 - protein, 10 aa, Homo Sapiens
VREISFNACL

SEQ ID NO: 6388 - protein, 10 aa, Homo Sapiens
LLAMAFDRFV

SEQ ID NO: 6389 - protein, 10 aa, Homo Sapiens
AFDRFVAVSN

SEQ ID NO: 6390 - protein, 10 aa, Homo Sapiens
GLLMLTPMVA

SEQ ID NO: 6391 - protein, 10 aa, Homo Sapiens
VLHHSYCYHP

SEQ ID NO: 6392 - protein, 10 aa, Homo Sapiens
VLSVASPEER

SEQ ID NO: 6393 - protein, 10 aa, Homo Sapiens
ERKETFSTCV

SEQ ID NO: 6394 - protein, 10 aa, Homo Sapiens
SLSIVHRFGK

SEQ ID NO: 6395 - protein, 10 aa, Homo Sapiens
YYFLSMLSAT

SEQ ID NO: 6396 - protein, 10 aa, Homo Sapiens
YFLSMLSATD

SEQ ID NO: 6397 - protein, 10 aa, Homo Sapiens
TLVTMLSIFW

SEQ ID NO: 6398 - protein, 10 aa, Homo Sapiens
MAFDRFVAVS

SEQ ID NO: 6399 - protein, 10 aa, Homo Sapiens
VSNPLRYAMI

SEQ ID NO: 6400 - protein, 10 aa, Homo Sapiens
VASVIRGLLM

SEQ ID NO: 6401 - protein, 10 aa, Homo Sapiens
ALLIRLSYCH

SEQ ID NO: 6402 - protein, 10 aa, Homo Sapiens
HSYCYHPDVM

SEQ ID NO: 6403 - protein, 10 aa, Homo Sapiens
KLSCTDTRIN

SEQ ID NO: 6404 - protein, 10 aa, Homo Sapiens
GLTAMFSTVG

SEQ ID NO: 6405 - protein, 10 aa, Homo Sapiens
FSTVGVDLLL

SEQ ID NO: 6406 - protein, 10 aa, Homo Sapiens
SYVLIIRTVL

SEQ ID NO: 6407 - protein, 10 aa, Homo Sapiens
RFGKQAPAYV

SEQ ID NO: 6408 - protein, 10 aa, Homo Sapiens
VHTMIANTYL

SEQ ID NO: 6409 - protein, 10 aa, Homo Sapiens
IKFFTVMESS

SEQ ID NO: 6410 - protein, 10 aa, Homo Sapiens
MESSVLLAMA

SEQ ID NO: 6411 - protein, 10 aa, Homo Sapiens
AMAFDRFVAV

SEQ ID NO: 6412 - protein, 10 aa, Homo Sapiens
RFVAVSNPLR

SEQ ID NO: 6413 - protein, 10 aa, Homo Sapiens
LSIVHRFGKQ

SEQ ID NO: 6414 - protein, 10 aa, Homo Sapiens
LMNPVIYSVK

SEQ ID NO: 6415 - protein, 10 aa, Homo Sapiens
KQIRRAVIKI

SEQ ID NO: 6416 - protein, 10 aa, Homo Sapiens
SATDLGLSIS

SEQ ID NO: 6417 - protein, 10 aa, Homo Sapiens
IFWFNVREIS

SEQ ID NO: 6418 - protein, 10 aa, Homo Sapiens
HMFFIKFFTV

SEQ ID NO: 6419 - protein, 10 aa, Homo Sapiens
FDRFVAVSNP

SEQ ID NO: 6420 - protein, 10 aa, Homo Sapiens
YCHSQVLHHS

SEQ ID NO: 6421 - protein, 10 aa, Homo Sapiens
CYHPDVMKLS

SEQ ID NO: 6422 - protein, 10 aa, Homo Sapiens
HPDVMKLSCT

SEQ ID NO: 6423 - protein, 10 aa, Homo Sapiens
SCTDTRINSA

SEQ ID NO: 6424 - protein, 10 aa, Homo Sapiens
TRINSAVGLT

SEQ ID NO: 6425 - protein, 10 aa, Homo Sapiens
IRTVLSVASP

SEQ ID NO: 6426 - protein, 10 aa, Homo Sapiens
TFSTCVSHIV

SEQ ID NO: 6427 - protein, 10 aa, Homo Sapiens
TCVSHIVAFA

SEQ ID NO: 6428 - protein, 10 aa, Homo Sapiens
GKQAPAYVHT

SEQ ID NO: 6429 - protein, 10 aa, Homo Sapiens
AYVHTMIANT

SEQ ID NO: 6430 - protein, 10 aa, Homo Sapiens
TMIANTYLLI

SEQ ID NO: 6431 - protein, 10 aa, Homo Sapiens
RRAVIKILHS

SEQ ID NO: 6432 - protein, 10 aa, Homo Sapiens
MYYFLSMLSA

SEQ ID NO: 6433 - protein, 10 aa, Homo Sapiens
ISTLVTMLSI

SEQ ID NO: 6434 - protein, 10 aa, Homo Sapiens
ACLSHMFFIK

SEQ ID NO: 6435 - protein, 10 aa, Homo Sapiens
SSVLLAMAFD

SEQ ID NO: 6436 - protein, 10 aa, Homo Sapiens
VAVSNPLRYA

SEQ ID NO: 6437 - protein, 10 aa, Homo Sapiens
AQIGVASVIR

SEQ ID NO: 6438 - protein, 10 aa, Homo Sapiens
VALLIRLSYC

SEQ ID NO: 6439 - protein, 10 aa, Homo Sapiens
SYCHSQVLHH

SEQ ID NO: 6440 - protein, 10 aa, Homo Sapiens
LHHSYCYHPD

SEQ ID NO: 6441 - protein, 10 aa, Homo Sapiens
VGLTAMFSTV

SEQ ID NO: 6442 - protein, 10 aa, Homo Sapiens
IYYIPLISLS

SEQ ID NO: 6443 - protein, 10 aa, Homo Sapiens
YYIPLISLSI

SEQ ID NO: 6444 - protein, 10 aa, Homo Sapiens
PAYVHTMIAN

SEQ ID NO: 6445 - protein, 10 aa, Homo Sapiens
IANTYLLISP

SEQ ID NO: 6446 - protein, 10 aa, Homo Sapiens
RAVIKILHSK

SEQ ID NO: 6447 - protein, 10 aa, Homo Sapiens
LSIFWFNVRE

SEQ ID NO: 6448 - protein, 10 aa, Homo Sapiens
NACLSHMFFI

SEQ ID NO: 6449 - protein, 10 aa, Homo Sapiens
NPLRYAMILT

SEQ ID NO: 6450 - protein, 10 aa, Homo Sapiens
LRYAMILTDS

SEQ ID NO: 6451 - protein, 10 aa, Homo Sapiens
SRIAQIGVAS

SEQ ID NO: 6452 - protein, 10 aa, Homo Sapiens
PMVALLIRLS

SEQ ID NO: 6453 - protein, 10 aa, Homo Sapiens
TAMFSTVGVD

SEQ ID NO: 6454 - protein, 10 aa, Homo Sapiens
LSYVLIIRTV

SEQ ID NO: 6455 - protein, 10 aa, Homo Sapiens
SPLMNPVIYS

SEQ ID NO: 6456 - protein, 10 aa, Homo Sapiens
NPVIYSVKTK

SEQ ID NO: 6457 - protein, 10 aa, Homo Sapiens
REISFNACLS

SEQ ID NO: 6458 - protein, 10 aa, Homo Sapiens
IRLSYCHSQV

SEQ ID NO: 6459 - protein, 10 aa, Homo Sapiens
YHPDVMKLSC

SEQ ID NO: 6460 - protein, 10 aa, Homo Sapiens
SAVGLTAMFS

SEQ ID NO: 6461 - protein, 10 aa, Homo Sapiens
VASPEERKET

SEQ ID NO: 6462 - protein, 10 aa, Homo Sapiens
MNPVIYSVKT

SEQ ID NO: 6463 - protein, 10 aa, Homo Sapiens
LSATDLGLSI

SEQ ID NO: 6464 - protein, 10 aa, Homo Sapiens
TMLSIFWFNV

SEQ ID NO: 6465 - protein, 10 aa, Homo Sapiens
RYAMILTDSR

SEQ ID NO: 6466 - protein, 10 aa, Homo Sapiens
YAMILTDSRI

SEQ ID NO: 6467 - protein, 10 aa, Homo Sapiens
AMILTDSRIA

SEQ ID NO: 6468 - protein, 10 aa, Homo Sapiens
RGLLMLTPMV

SEQ ID NO: 6469 - protein, 10 aa, Homo Sapiens
SYCYHPDVMK

SEQ ID NO: 6470 - protein, 10 aa, Homo Sapiens
MKLSCTDTRI

SEQ ID NO: 6471 - protein, 10 aa, Homo Sapiens
SPEERKETFS

SEQ ID NO: 6472 - protein, 10 aa, Homo Sapiens
KETFSTCVSH

SEQ ID NO: 6473 - protein, 10 aa, Homo Sapiens
FAIYYIPLIS

SEQ ID NO: 6474 - protein, 10 aa, Homo Sapiens
FGKQAPAYVH

SEQ ID NO: 6475 - protein, 10 aa, Homo Sapiens
QAPAYVHTMI

SEQ ID NO: 6476 - protein, 10 aa, Homo Sapiens
APAYVHTMIA

SEQ ID NO: 6477 - protein, 10 aa, Homo Sapiens
YSVKTKQIRR

SEQ ID NO: 6478 - protein, 10 aa, Homo Sapiens
VKTKQIRRAV

SEQ ID NO: 6479 - protein, 10 aa, Homo Sapiens
LGLSISTLVT

SEQ ID NO: 6480 - protein, 10 aa, Homo Sapiens
FNVREISFNA

SEQ ID NO: 6481 - protein, 10 aa, Homo Sapiens
TDSRIAQIGV

SEQ ID NO: 6482 - protein, 10 aa, Homo Sapiens
IAQIGVASVI

SEQ ID NO: 6483 - protein, 10 aa, Homo Sapiens
LSYCHSQVLH

SEQ ID NO: 6484 - protein, 10 aa, Homo Sapiens
HSQVLHHSYC

SEQ ID NO: 6485 - protein, 10 aa, Homo Sapiens
HHSYCYHPDV

SEQ ID NO: 6486 - protein, 10 aa, Homo Sapiens
VMKLSCTDTR

SEQ ID NO: 6487 - protein, 10 aa, Homo Sapiens
LSCTDTRINS

SEQ ID NO: 6488 - protein, 10 aa, Homo Sapiens
TDTRINSAVG

SEQ ID NO: 6489 - protein, 10 aa, Homo Sapiens
LSVASPEERK

SEQ ID NO: 6490 - protein, 10 aa, Homo Sapiens
PEERKETFST

SEQ ID NO: 6491 - protein, 10 aa, Homo Sapiens
ISLSIVHRFG

SEQ ID NO: 6492 - protein, 10 aa, Homo Sapiens
VHRFGKQAPA

SEQ ID NO: 6493 - protein, 10 aa, Homo Sapiens
TYLLISPLMN

SEQ ID NO: 6494 - protein, 10 aa, Homo Sapiens
IYSVKTKQIR

SEQ ID NO: 6495 - protein, 10 aa, Homo Sapiens
TKQIRRAVIK

SEQ ID NO: 6496 - protein, 10 aa, Homo Sapiens
MVALLIRLSY

SEQ ID NO: 6497 - protein, 10 aa, Homo Sapiens
SLSIVHRFGK

SEQ ID NO: 6498 - protein, 10 aa, Homo Sapiens
YVHTMIANTY

SEQ ID NO: 6499 - protein, 10 aa, Homo Sapiens
RINSAVGLTA

SEQ ID NO: 6500 - protein, 10 aa, Homo Sapiens
SVLLAMAFDR

SEQ ID NO: 6501 - protein, 10 aa, Homo Sapiens
FVAVSNPLRY

SEQ ID NO: 6502 - protein, 10 aa, Homo Sapiens
LIIRTVLSVA

SEQ ID NO: 6503 - protein, 10 aa, Homo Sapiens
PLISLSIVHR

SEQ ID NO: 6504 - protein, 10 aa, Homo Sapiens
PLRYAMILTD

SEQ ID NO: 6505 - protein, 10 aa, Homo Sapiens
VIRGLLMLTP

SEQ ID NO: 6506 - protein, 10 aa, Homo Sapiens
ALLIRLSYCH

SEQ ID NO: 6507 - protein, 10 aa, Homo Sapiens
LMNPVIYSVK

SEQ ID NO: 6508 - protein, 10 aa, Homo Sapiens
GLSISTLVTM

SEQ ID NO: 6509 - protein, 10 aa, Homo Sapiens
MLSIFWFNVR

SEQ ID NO: 6510 - protein, 10 aa, Homo Sapiens
ILTDSRIAQI

SEQ ID NO: 6511 - protein, 10 aa, Homo Sapiens
MLTPMVALLI

SEQ ID NO: 6512 - protein, 10 aa, Homo Sapiens
VLIIRTVLSV

SEQ ID NO: 6513 - protein, 10 aa, Homo Sapiens
AVIKILHSKE

SEQ ID NO: 6514 - protein, 10 aa, Homo Sapiens
VLLAMAFDRF

SEQ ID NO: 6515 - protein, 10 aa, Homo Sapiens
RIAQIGVASV

SEQ ID NO: 6516 - protein, 10 aa, Homo Sapiens
SVIRGLLMLT

SEQ ID NO: 6517 - protein, 10 aa, Homo Sapiens
GLLMLTPMVA

SEQ ID NO: 6518 - protein, 10 aa, Homo Sapiens
RLSYCHSQVL

SEQ ID NO: 6519 - protein, 10 aa, Homo Sapiens
QVLHHSYCYH

SEQ ID NO: 6520 - protein, 10 aa, Homo Sapiens
LLILLSYVLI

SEQ ID NO: 6521 - protein, 10 aa, Homo Sapiens
ILLSYVLIIR

SEQ ID NO: 6522 - protein, 10 aa, Homo Sapiens
IIRTVLSVAS

SEQ ID NO: 6523 - protein, 10 aa, Homo Sapiens
TKQIRRAVIK

SEQ ID NO: 6524 - protein, 10 aa, Homo Sapiens
EISFNACLSH

SEQ ID NO: 6525 - protein, 10 aa, Homo Sapiens
GLTAMFSTVG

SEQ ID NO: 6526 - protein, 10 aa, Homo Sapiens
LLLILLSYVL

SEQ ID NO: 6527 - protein, 10 aa, Homo Sapiens
YVLIIRTVLS

SEQ ID NO: 6528 - protein, 10 aa, Homo Sapiens
AIYYIPLISL

SEQ ID NO: 6529 - protein, 10 aa, Homo Sapiens
RAVIKILHSK

SEQ ID NO: 6530 - protein, 10 aa, Homo Sapiens
AVSNPLRYAM

SEQ ID NO: 6531 - protein, 10 aa, Homo Sapiens
AQIGVASVIR

SEQ ID NO: 6532 - protein, 10 aa, Homo Sapiens
LLMLTPMVAL

SEQ ID NO: 6533 - protein, 10 aa, Homo Sapiens
LLIRLSYCHS

SEQ ID NO: 6534 - protein, 10 aa, Homo Sapiens
SYCYHPDVMK

SEQ ID NO: 6535 - protein, 10 aa, Homo Sapiens
AVGLTAMFST

SEQ ID NO: 6536 - protein, 10 aa, Homo Sapiens
DLLLILLSYV

SEQ ID NO: 6537 - protein, 10 aa, Homo Sapiens
IVHRFGKQAP

SEQ ID NO: 6538 - protein, 10 aa, Homo Sapiens
QIRRAVIKIL

SEQ ID NO: 6539 - protein, 10 aa, Homo Sapiens
LVTMLSIFWF

SEQ ID NO: 6540 - protein, 10 aa, Homo Sapiens
NVREISFNAC

SEQ ID NO: 6541 - protein, 10 aa, Homo Sapiens
ACLSHMFFIK

SEQ ID NO: 6542 - protein, 10 aa, Homo Sapiens
AFDRFVAVSN

SEQ ID NO: 6543 - protein, 10 aa, Homo Sapiens
VLSVASPEER

SEQ ID NO: 6544 - protein, 10 aa, Homo Sapiens
SIVHRFGKQA

SEQ ID NO: 6545 - protein, 10 aa, Homo Sapiens
LISPLMNPVI

SEQ ID NO: 6546 - protein, 10 aa, Homo Sapiens
NPVIYSVKTK

SEQ ID NO: 6547 - protein, 10 aa, Homo Sapiens
VIYSVKTKQI

SEQ ID NO: 6548 - protein, 10 aa, Homo Sapiens
FLSMLSATDL

SEQ ID NO: 6549 - protein, 10 aa, Homo Sapiens
CLSHMFFIKF

SEQ ID NO: 6550 - protein, 10 aa, Homo Sapiens
TVMESSVLLA

SEQ ID NO: 6551 - protein, 10 aa, Homo Sapiens
SRIAQIGVAS

SEQ ID NO: 6552 - protein, 10 aa, Homo Sapiens
LIRLSYCHSQ

SEQ ID NO: 6553 - protein, 10 aa, Homo Sapiens
GVDLLLILLS

SEQ ID NO: 6554 - protein, 10 aa, Homo Sapiens
VDLLLILLSY

SEQ ID NO: 6555 - protein, 10 aa, Homo Sapiens
LILLSYVLII

SEQ ID NO: 6556 - protein, 10 aa, Homo Sapiens
CVSHIVAFAI

SEQ ID NO: 6557 - protein, 10 aa, Homo Sapiens
YLLISPLMNP

SEQ ID NO: 6558 - protein, 10 aa, Homo Sapiens
ISPLMNPVIY

SEQ ID NO: 6559 - protein, 10 aa, Homo Sapiens
PVIYSVKTKQ

SEQ ID NO: 6560 - protein, 10 aa, Homo Sapiens
MLSATDLGLS

SEQ ID NO: 6561 - protein, 10 aa, Homo Sapiens
IAQIGVASVI

SEQ ID NO: 6562 - protein, 10 aa, Homo Sapiens
GVASVIRGLL

SEQ ID NO: 6563 - protein, 10 aa, Homo Sapiens
KLSCTDTRIN

SEQ ID NO: 6564 - protein, 10 aa, Homo Sapiens
TVGVDLLLIL

SEQ ID NO: 6565 - protein, 10 aa, Homo Sapiens
KETFSTCVSH

SEQ ID NO: 6566 - protein, 10 aa, Homo Sapiens
SHIVAFAIYY

SEQ ID NO: 6567 - protein, 10 aa, Homo Sapiens
IVAFAIYYIP

SEQ ID NO: 6568 - protein, 10 aa, Homo Sapiens
IPLISLSIVH

SEQ ID NO: 6569 - protein, 10 aa, Homo Sapiens
LISLSIVHRF

SEQ ID NO: 6570 - protein, 10 aa, Homo Sapiens
MIANTYLLIS

SEQ ID NO: 6571 - protein, 10 aa, Homo Sapiens
LLISPLMNPV

SEQ ID NO: 6572 - protein, 10 aa, Homo Sapiens
PLMNPVIYSV

SEQ ID NO: 6573 - protein, 10 aa, Homo Sapiens
DLGLSISTLV

SEQ ID NO: 6574 - protein, 10 aa, Homo Sapiens
MILTDSRIAQ

SEQ ID NO: 6575 - protein, 10 aa, Homo Sapiens
LSYCHSQVLH

SEQ ID NO: 6576 - protein, 10 aa, Homo Sapiens
TVLSVASPEE

SEQ ID NO: 6577 - protein, 10 aa, Homo Sapiens
LSVASPEERK

SEQ ID NO: 6578 - protein, 10 aa, Homo Sapiens
SVASPEERKE

SEQ ID NO: 6579 - protein, 10 aa, Homo Sapiens
ASPEERKETF

SEQ ID NO: 6580 - protein, 10 aa, Homo Sapiens
YIPLISLSIV

SEQ ID NO: 6581 - protein, 10 aa, Homo Sapiens
HRFGKQAPAY

SEQ ID NO: 6582 - protein, 10 aa, Homo Sapiens
FGKQAPAYVH

SEQ ID NO: 6583 - protein, 10 aa, Homo Sapiens
SVKTKQIRRA

SEQ ID NO: 6584 - protein, 10 aa, Homo Sapiens
KTKQIRRAVI

SEQ ID NO: 6585 - protein, 10 aa, Homo Sapiens
TDLGLSISTL

SEQ ID NO: 6586 - protein, 10 aa, Homo Sapiens
LLAMAFDRFV

SEQ ID NO: 6587 - protein, 10 aa, Homo Sapiens
RYAMILTDSR

SEQ ID NO: 6588 - protein, 10 aa, Homo Sapiens
DVMKLSCTDT

SEQ ID NO: 6589 - protein, 10 aa, Homo Sapiens
DTRINSAVGL

SEQ ID NO: 6590 - protein, 10 aa, Homo Sapiens
RTVLSVASPE

SEQ ID NO: 6591 - protein, 10 aa, Homo Sapiens
YYIPLISLSI

SEQ ID NO: 6592 - protein, 10 aa, Homo Sapiens
KQAPAYVHTM

SEQ ID NO: 6593 - protein, 10 aa, Homo Sapiens
IRRAVIKILH

SEQ ID NO: 6594 - protein, 10 aa, Homo Sapiens
SISTLVTMLS

SEQ ID NO: 6595 - protein, 10 aa, Homo Sapiens
STLVTMLSIF

SEQ ID NO: 6596 - protein, 10 aa, Homo Sapiens
TLVTMLSIFW

SEQ ID NO: 6597 - protein, 10 aa, Homo Sapiens
REISFNACLS

SEQ ID NO: 6598 - protein, 10 aa, Homo Sapiens
FIKFFTVMES

SEQ ID NO: 6599 - protein, 10 aa, Homo Sapiens
RFVAVSNPLR

SEQ ID NO: 6600 - protein, 10 aa, Homo Sapiens
QIGVASVIRG

SEQ ID NO: 6601 - protein, 10 aa, Homo Sapiens
IRLSYCHSQV

SEQ ID NO: 6602 - protein, 10 aa, Homo Sapiens
VLHHSYCYHP

SEQ ID NO: 6603 - protein, 10 aa, Homo Sapiens
VMKLSCTDTR

SEQ ID NO: 6604 - protein, 10 aa, Homo Sapiens
TDTRINSAVG

SEQ ID NO: 6605 - protein, 10 aa, Homo Sapiens
AMFSTVGVDL

SEQ ID NO: 6606 - protein, 10 aa, Homo Sapiens
LLSYVLIIRT

SEQ ID NO: 6607 - protein, 10 aa, Homo Sapiens
EERKETFSTC

SEQ ID NO: 6608 - protein, 10 aa, Homo Sapiens
STCVSHIVAF

SEQ ID NO: 6609 - protein, 10 aa, Homo Sapiens
VSHIVAFAIY

SEQ ID NO: 6610 - protein, 10 aa, Homo Sapiens
HIVAFAIYYI

SEQ ID NO: 6611 - protein, 10 aa, Homo Sapiens
IYYIPLISLS

SEQ ID NO: 6612 - protein, 10 aa, Homo Sapiens
VIKILHSKET

SEQ ID NO: 6613 - protein, 10 aa, Homo Sapiens
MYYFLSMLSA

SEQ ID NO: 6614 - protein, 10 aa, Homo Sapiens
YFLSMLSATD

SEQ ID NO: 6615 - protein, 10 aa, Homo Sapiens
LSATDLGLSI

SEQ ID NO: 6616 - protein, 10 aa, Homo Sapiens
LGLSISTLVT

SEQ ID NO: 6617 - protein, 10 aa, Homo Sapiens
SIFWFNVREI

SEQ ID NO: 6618 - protein, 10 aa, Homo Sapiens
ESSVLLAMAF

SEQ ID NO: 6619 - protein, 10 aa, Homo Sapiens
AMAFDRFVAV

SEQ ID NO: 6620 - protein, 10 aa, Homo Sapiens
DSRIAQIGVA

SEQ ID NO: 6621 - protein, 10 aa, Homo Sapiens
HSYCYHPDVM

SEQ ID NO: 6622 - protein, 10 aa, Homo Sapiens
NSAVGLTAMF

SEQ ID NO: 6623 - protein, 10 aa, Homo Sapiens
VGLTAMFSTV

SEQ ID NO: 6624 - protein, 10 aa, Homo Sapiens
KQIRRAVIKI

SEQ ID NO: 6625 - protein, 10 aa, Homo Sapiens
ISTLVTMLSI

SEQ ID NO: 6626 - protein, 10 aa, Homo Sapiens
SFNACLSHMF

SEQ ID NO: 6627 - protein, 10 aa, Homo Sapiens
FFIKFFTVME

SEQ ID NO: 6628 - protein, 10 aa, Homo Sapiens
KFFTVMESSV

SEQ ID NO: 6629 - protein, 10 aa, Homo Sapiens
MAFDRFVAVS

SEQ ID NO: 6630 - protein, 10 aa, Homo Sapiens
ASVIRGLLML

SEQ ID NO: 6631 - protein, 10 aa, Homo Sapiens
RGLLMLTPMV

SEQ ID NO: 6632 - protein, 10 aa, Homo Sapiens
SYCHSQVLHH

SEQ ID NO: 6633 - protein, 10 aa, Homo Sapiens
CHSQVLHHSY

SEQ ID NO: 6634 - protein, 10 aa, Homo Sapiens
SQVLHHSYCY

SEQ ID NO: 6635 - protein, 10 aa, Homo Sapiens
LSYVLIIRTV

SEQ ID NO: 6636 - protein, 10 aa, Homo Sapiens
SYVLIIRTVL

SEQ ID NO: 6637 - protein, 10 aa, Homo Sapiens
RKETFSTCVS

SEQ ID NO: 6638 - protein, 10 aa, Homo Sapiens
RFGKQAPAYV

SEQ ID NO: 6639 - protein, 10 aa, Homo Sapiens
TMIANTYLLI

SEQ ID NO: 6640 - protein, 10 aa, Homo Sapiens
TYLLISPLMN

SEQ ID NO: 6641 - protein, 10 aa, Homo Sapiens
RRAVIKILHS

SEQ ID NO: 6642 - protein, 10 aa, Homo Sapiens
LSIFWFNVRE

SEQ ID NO: 6643 - protein, 10 aa, Homo Sapiens
FWFNVREISF

SEQ ID NO: 6644 - protein, 10 aa, Homo Sapiens
FFTVMESSVL

SEQ ID NO: 6645 - protein, 10 aa, Homo Sapiens
LAMAFDRFVA

SEQ ID NO: 6646 - protein, 10 aa, Homo Sapiens
VSNPLRYAMI

SEQ ID NO: 6647 - protein, 10 aa, Homo Sapiens
LRYAMILTDS

SEQ ID NO: 6648 - protein, 10 aa, Homo Sapiens
AMILTDSRIA

SEQ ID NO: 6649 - protein, 10 aa, Homo Sapiens
LTPMVALLIR

SEQ ID NO: 6650 - protein, 10 aa, Homo Sapiens
SAVGLTAMFS

SEQ ID NO: 6651 - protein, 10 aa, Homo Sapiens
IRTVLSVASP

SEQ ID NO: 6652 - protein, 10 aa, Homo Sapiens
FAIYYIPLIS

SEQ ID NO: 6653 - protein, 10 aa, Homo Sapiens
SMLSATDLGL

SEQ ID NO: 6654 - protein, 10 aa, Homo Sapiens
ATDLGLSIST

SEQ ID NO: 6655 - protein, 10 aa, Homo Sapiens
ISFNACLSHM

SEQ ID NO: 6656 - protein, 10 aa, Homo Sapiens
FNACLSHMFF

SEQ ID NO: 6657 - protein, 10 aa, Homo Sapiens
MFFIKFFTVM

SEQ ID NO: 6658 - protein, 10 aa, Homo Sapiens
FDRFVAVSNP

SEQ ID NO: 6659 - protein, 10 aa, Homo Sapiens
SNPLRYAMIL

SEQ ID NO: 6660 - protein, 10 aa, Homo Sapiens
VASVIRGLLM

SEQ ID NO: 6661 - protein, 10 aa, Homo Sapiens
VALLIRLSYC

SEQ ID NO: 6662 - protein, 10 aa, Homo Sapiens
YHPDVMKLSC

SEQ ID NO: 6663 - protein, 10 aa, Homo Sapiens
INSAVGLTAM

SEQ ID NO: 6664 - protein, 10 aa, Homo Sapiens
STVGVDLLLI

SEQ ID NO: 6665 - protein, 10 aa, Homo Sapiens
VHRFGKQAPA

SEQ ID NO: 6666 - protein, 10 aa, Homo Sapiens
GKQAPAYVHT

SEQ ID NO: 6667 - protein, 10 aa, Homo Sapiens
QAPAYVHTMI

SEQ ID NO: 6668 - protein, 10 aa, Homo Sapiens
AYVHTMIANT

SEQ ID NO: 6669 - protein, 10 aa, Homo Sapiens
ANTYLLISPL

SEQ ID NO: 6670 - protein, 10 aa, Homo Sapiens
IYSVKTKQIR

SEQ ID NO: 6671 - protein, 10 aa, Homo Sapiens
YYFLSMLSAT

SEQ ID NO: 6672 - protein, 10 aa, Homo Sapiens
SATDLGLSIS

SEQ ID NO: 6673 - protein, 10 aa, Homo Sapiens
LSISTLVTML

SEQ ID NO: 6674 - protein, 10 aa, Homo Sapiens
SSVLLAMAFD

SEQ ID NO: 6675 - protein, 10 aa, Homo Sapiens
NPLRYAMILT

SEQ ID NO: 6676 - protein, 10 aa, Homo Sapiens
LMLTPMVALL

SEQ ID NO: 6677 - protein, 10 aa, Homo Sapiens
YCYHPDVMKL

SEQ ID NO: 6678 - protein, 10 aa, Homo Sapiens
TRINSAVGLT

SEQ ID NO: 6679 - protein, 10 aa, Homo Sapiens
LTAMFSTVGV

SEQ ID NO: 6680 - protein, 10 aa, Homo Sapiens
TAMFSTVGVD

SEQ ID NO: 6681 - protein, 10 aa, Homo Sapiens
PEERKETFST

SEQ ID NO: 6682 - protein, 10 aa, Homo Sapiens
AFAIYYIPLI

SEQ ID NO: 6683 - protein, 10 aa, Homo Sapiens
APAYVHTMIA

SEQ ID NO: 6684 - protein, 10 aa, Homo Sapiens
PAYVHTMIAN

SEQ ID NO: 6685 - protein, 10 aa, Homo Sapiens
NTYLLISPLM

SEQ ID NO: 6686 - protein, 10 aa, Homo Sapiens
VREISFNACL

SEQ ID NO: 6687 - protein, 10 aa, Homo Sapiens
LSHMFFIKFF

SEQ ID NO: 6688 - protein, 10 aa, Homo Sapiens
HMFFIKFFTV

SEQ ID NO: 6689 - protein, 10 aa, Homo Sapiens
IKFFTVMESS

SEQ ID NO: 6690 - protein, 10 aa, Homo Sapiens
FTVMESSVLL

SEQ ID NO: 6691 - protein, 10 aa, Homo Sapiens
VMESSVLLAM

SEQ ID NO: 6692 - protein, 10 aa, Homo Sapiens
MESSVLLAMA

SEQ ID NO: 6693 - protein, 10 aa, Homo Sapiens
YAMILTDSRI

SEQ ID NO: 6694 - protein, 10 aa, Homo Sapiens
IGVASVIRGL

SEQ ID NO: 6695 - protein, 10 aa, Homo Sapiens
IRGLLMLTPM

SEQ ID NO: 6696 - protein, 10 aa, Homo Sapiens
PDVMKLSCTD

SEQ ID NO: 6697 - protein, 10 aa, Homo Sapiens
SCTDTRINSA

SEQ ID NO: 6698 - protein, 10 aa, Homo Sapiens
CTDTRINSAV

SEQ ID NO: 6699 - protein, 10 aa, Homo Sapiens
VASPEERKET

SEQ ID NO: 6700 - protein, 10 aa, Homo Sapiens
FSTCVSHIVA

SEQ ID NO: 6701 - protein, 10 aa, Homo Sapiens
ISLSIVHRFG

SEQ ID NO: 6702 - protein, 10 aa, Homo Sapiens
LSIVHRFGKQ

SEQ ID NO: 6703 - protein, 10 aa, Homo Sapiens
IANTYLLISP

SEQ ID NO: 6704 - protein, 10 aa, Homo Sapiens
MNPVIYSVKT

SEQ ID NO: 6705 - protein, 10 aa, Homo Sapiens
YSVKTKQIRR

SEQ ID NO: 6706 - protein, 10 aa, Homo Sapiens
IFWFNVREIS

SEQ ID NO: 6707 - protein, 10 aa, Homo Sapiens
WFNVREISFN

SEQ ID NO: 6708 - protein, 10 aa, Homo Sapiens
FNVREISFNA

SEQ ID NO: 6709 - protein, 10 aa, Homo Sapiens
LTDSRIAQIG

SEQ ID NO: 6710 - protein, 10 aa, Homo Sapiens
TDSRIAQIGV

SEQ ID NO: 6711 - protein, 10 aa, Homo Sapiens
HSQVLHHSYC

SEQ ID NO: 6712 - protein, 10 aa, Homo Sapiens
CYHPDVMKLS

SEQ ID NO: 6713 - protein, 10 aa, Homo Sapiens
HPDVMKLSCT

SEQ ID NO: 6714 - protein, 10 aa, Homo Sapiens
MKLSCTDTRI

SEQ ID NO: 6715 - protein, 10 aa, Homo Sapiens
FSTVGVDLLL

SEQ ID NO: 6716 - protein, 10 aa, Homo Sapiens
SPEERKETFS

SEQ ID NO: 6717 - protein, 10 aa, Homo Sapiens
ERKETFSTCV

SEQ ID NO: 6718 - protein, 10 aa, Homo Sapiens
ETFSTCVSHI

SEQ ID NO: 6719 - protein, 10 aa, Homo Sapiens
TCVSHIVAFA

SEQ ID NO: 6720 - protein, 10 aa, Homo Sapiens
SPLMNPVIYS

SEQ ID NO: 6721 - protein, 10 aa, Homo Sapiens
TMLSIFWFNV

SEQ ID NO: 6722 - protein, 10 aa, Homo Sapiens
PMVALLIRLS

SEQ ID NO: 6723 - protein, 10 aa, Homo Sapiens
VAFAIYYIPL

SEQ ID NO: 6724 - protein, 10 aa, Homo Sapiens
VKTKQIRRAV

SEQ ID NO: 6725 - protein, 10 aa, Homo Sapiens
LSMLSATDLG

SEQ ID NO: 6726 - protein, 10 aa, Homo Sapiens
VTMLSIFWFN

SEQ ID NO: 6727 - protein, 10 aa, Homo Sapiens
NACLSHMFFI

SEQ ID NO: 6728 - protein, 10 aa, Homo Sapiens
SHMFFIKFFT

SEQ ID NO: 6729 - protein, 10 aa, Homo Sapiens
LSCTDTRINS

SEQ ID NO: 6730 - protein, 10 aa, Homo Sapiens
VGVDLLLILL

SEQ ID NO: 6731 - protein, 10 aa, Homo Sapiens
VHTMIANTYL

SEQ ID NO: 6732 - protein, 10 aa, Homo Sapiens
HTMIANTYLL

SEQ ID NO: 6733 - protein, 10 aa, Homo Sapiens
TPMVALLIRL

SEQ ID NO: 6734 - protein, 10 aa, Homo Sapiens
APAYVHTMIA

SEQ ID NO: 6735 - protein, 10 aa, Homo Sapiens
HPDVMKLSCT

SEQ ID NO: 6736 - protein, 10 aa, Homo Sapiens
NPLRYAMILT

SEQ ID NO: 6737 - protein, 10 aa, Homo Sapiens
ASVIRGLLML

SEQ ID NO: 6738 - protein, 10 aa, Homo Sapiens
LLMLTPMVAL

SEQ ID NO: 6739 - protein, 10 aa, Homo Sapiens
RLSYCHSQVL

SEQ ID NO: 6740 - protein, 10 aa, Homo Sapiens
DTRINSAVGL

SEQ ID NO: 6741 - protein, 10 aa, Homo Sapiens
AMFSTVGVDL

SEQ ID NO: 6742 - protein, 10 aa, Homo Sapiens
FLSMLSATDL

SEQ ID NO: 6743 - protein, 10 aa, Homo Sapiens
AMAFDRFVAV

SEQ ID NO: 6744 - protein, 10 aa, Homo Sapiens
MFSTVGVDLL

SEQ ID NO: 6745 - protein, 10 aa, Homo Sapiens
TVGVDLLLIL

SEQ ID NO: 6746 - protein, 10 aa, Homo Sapiens
SYVLIIRTVL

SEQ ID NO: 6747 - protein, 10 aa, Homo Sapiens
ANTYLLISPL

SEQ ID NO: 6748 - protein, 10 aa, Homo Sapiens
SMLSATDLGL

SEQ ID NO: 6749 - protein, 10 aa, Homo Sapiens
TDLGLSISTL

SEQ ID NO: 6750 - protein, 10 aa, Homo Sapiens
LSISTLVTML

SEQ ID NO: 6751 - protein, 10 aa, Homo Sapiens
FTVMESSVLL

SEQ ID NO: 6752 - protein, 10 aa, Homo Sapiens
AVSNPLRYAM

SEQ ID NO: 6753 - protein, 10 aa, Homo Sapiens
IGVASVIRGL

SEQ ID NO: 6754 - protein, 10 aa, Homo Sapiens
GVASVIRGLL

SEQ ID NO: 6755 - protein, 10 aa, Homo Sapiens
LMLTPMVALL

SEQ ID NO: 6756 - protein, 10 aa, Homo Sapiens
INSAVGLTAM

SEQ ID NO: 6757 - protein, 10 aa, Homo Sapiens
FSTVGVDLLL

SEQ ID NO: 6758 - protein, 10 aa, Homo Sapiens
SPEERKETFS

SEQ ID NO: 6759 - protein, 10 aa, Homo Sapiens
VAFAIYYIPL

SEQ ID NO: 6760 - protein, 10 aa, Homo Sapiens
AIYYIPLISL

SEQ ID NO: 6761 - protein, 10 aa, Homo Sapiens
IPLISLSIVH

SEQ ID NO: 6762 - protein, 10 aa, Homo Sapiens
HTMIANTYLL

SEQ ID NO: 6763 - protein, 10 aa, Homo Sapiens
QIRRAVIKIL

SEQ ID NO: 6764 - protein, 10 aa, Homo Sapiens
VREISFNACL

SEQ ID NO: 6765 - protein, 10 aa, Homo Sapiens
FFTVMESSVL

SEQ ID NO: 6766 - protein, 10 aa, Homo Sapiens
DRFVAVSNPL

SEQ ID NO: 6767 - protein, 10 aa, Homo Sapiens
YCYHPDVMKL

SEQ ID NO: 6768 - protein, 10 aa, Homo Sapiens
LLLILLSYVL

SEQ ID NO: 6769 - protein, 10 aa, Homo Sapiens
VHTMIANTYL

SEQ ID NO: 6770 - protein, 10 aa, Homo Sapiens
LISPLMNPVI

SEQ ID NO: 6771 - protein, 10 aa, Homo Sapiens
SPLMNPVIYS

SEQ ID NO: 6772 - protein, 10 aa, Homo Sapiens
NPVIYSVKTK

SEQ ID NO: 6773 - protein, 10 aa, Homo Sapiens
LGLSISTLVT

SEQ ID NO: 6774 - protein, 10 aa, Homo Sapiens
GLSISTLVTM

SEQ ID NO: 6775 - protein, 10 aa, Homo Sapiens
TVMESSVLLA

SEQ ID NO: 6776 - protein, 10 aa, Homo Sapiens
ESSVLLAMAF

SEQ ID NO: 6777 - protein, 10 aa, Homo Sapiens
LAMAFDRFVA

SEQ ID NO: 6778 - protein, 10 aa, Homo Sapiens
SNPLRYAMIL

SEQ ID NO: 6779 - protein, 10 aa, Homo Sapiens
RIAQIGVASV

SEQ ID NO: 6780 - protein, 10 aa, Homo Sapiens
VASVIRGLLM

SEQ ID NO: 6781 - protein, 10 aa, Homo Sapiens
IRGLLMLTPM

SEQ ID NO: 6782 - protein, 10 aa, Homo Sapiens
LTAMFSTVGV

SEQ ID NO: 6783 - protein, 10 aa, Homo Sapiens
STVGVDLLLI

SEQ ID NO: 6784 - protein, 10 aa, Homo Sapiens
VGVDLLLILL

SEQ ID NO: 6785 - protein, 10 aa, Homo Sapiens
VASPEERKET

SEQ ID NO: 6786 - protein, 10 aa, Homo Sapiens
AFAIYYIPLI

SEQ ID NO: 6787 - protein, 10 aa, Homo Sapiens
VHRFGKQAPA

SEQ ID NO: 6788 - protein, 10 aa, Homo Sapiens
RFGKQAPAYV

SEQ ID NO: 6789 - protein, 10 aa, Homo Sapiens
KQAPAYVHTM

SEQ ID NO: 6790 - protein, 10 aa, Homo Sapiens
KTKQIRRAVI

SEQ ID NO: 6791 - protein, 10 aa, Homo Sapiens
LSATDLGLSI

SEQ ID NO: 6792 - protein, 10 aa, Homo Sapiens
ATDLGLSIST

SEQ ID NO: 6793 - protein, 10 aa, Homo Sapiens
ISTLVTMLSI

SEQ ID NO: 6794 - protein, 10 aa, Homo Sapiens
CLSHMFFIKF

SEQ ID NO: 6795 - protein, 10 aa, Homo Sapiens
MFFIKFFTVM

SEQ ID NO: 6796 - protein, 10 aa, Homo Sapiens
VMESSVLLAM

SEQ ID NO: 6797 - protein, 10 aa, Homo Sapiens
MESSVLLAMA

SEQ ID NO: 6798 - protein, 10 aa, Homo Sapiens
DSRIAQIGVA

SEQ ID NO: 6799 - protein, 10 aa, Homo Sapiens
RGLLMLTPMV

SEQ ID NO: 6800 - protein, 10 aa, Homo Sapiens
MLTPMVALLI

SEQ ID NO: 6801 - protein, 10 aa, Homo Sapiens
HHSYCYHPDV

SEQ ID NO: 6802 - protein, 10 aa, Homo Sapiens
DVMKLSCTDT

SEQ ID NO: 6803 - protein, 10 aa, Homo Sapiens
RINSAVGLTA

SEQ ID NO: 6804 - protein, 10 aa, Homo Sapiens
NSAVGLTAMF

SEQ ID NO: 6805 - protein, 10 aa, Homo Sapiens
AVGLTAMFST

SEQ ID NO: 6806 - protein, 10 aa, Homo Sapiens
LILLSYVLII

SEQ ID NO: 6807 - protein, 10 aa, Homo Sapiens
VLIIRTVLSV

SEQ ID NO: 6808 - protein, 10 aa, Homo Sapiens
STCVSHIVAF

SEQ ID NO: 6809 - protein, 10 aa, Homo Sapiens
TCVSHIVAFA

SEQ ID NO: 6810 - protein, 10 aa, Homo Sapiens
CVSHIVAFAI

SEQ ID NO: 6811 - protein, 10 aa, Homo Sapiens
YYIPLISLSI

SEQ ID NO: 6812 - protein, 10 aa, Homo Sapiens
LISLSIVHRF

SEQ ID NO: 6813 - protein, 10 aa, Homo Sapiens
GKQAPAYVHT

SEQ ID NO: 6814 - protein, 10 aa, Homo Sapiens
AYVHTMIANT

SEQ ID NO: 6815 - protein, 10 aa, Homo Sapiens
TMIANTYLLI

SEQ ID NO: 6816 - protein, 10 aa, Homo Sapiens
VKTKQIRRAV

SEQ ID NO: 6817 - protein, 10 aa, Homo Sapiens
MYYFLSMLSA

SEQ ID NO: 6818 - protein, 10 aa, Homo Sapiens
DLGLSISTLV

SEQ ID NO: 6819 - protein, 10 aa, Homo Sapiens
FNACLSHMFF

SEQ ID NO: 6820 - protein, 10 aa, Homo Sapiens
SHMFFIKFFT

SEQ ID NO: 6821 - protein, 10 aa, Homo Sapiens
VLLAMAFDRF

SEQ ID NO: 6822 - protein, 10 aa, Homo Sapiens
LLAMAFDRFV

SEQ ID NO: 6823 - protein, 10 aa, Homo Sapiens
VSNPLRYAMI

SEQ ID NO: 6824 - protein, 10 aa, Homo Sapiens
AMILTDSRIA

SEQ ID NO: 6825 - protein, 10 aa, Homo Sapiens
ILTDSRIAQI

SEQ ID NO: 6826 - protein, 10 aa, Homo Sapiens
TDSRIAQIGV

SEQ ID NO: 6827 - protein, 10 aa, Homo Sapiens
IAQIGVASVI

SEQ ID NO: 6828 - protein, 10 aa, Homo Sapiens
CTDTRINSAV

SEQ ID NO: 6829 - protein, 10 aa, Homo Sapiens
LLILLSYVLI

SEQ ID NO: 6830 - protein, 10 aa, Homo Sapiens
LLSYVLIIRT

SEQ ID NO: 6831 - protein, 10 aa, Homo Sapiens
ASPEERKETF

SEQ ID NO: 6832 - protein, 10 aa, Homo Sapiens
ERKETFSTCV

SEQ ID NO: 6833 - protein, 10 aa, Homo Sapiens
ETFSTCVSHI

SEQ ID NO: 6834 - protein, 10 aa, Homo Sapiens
TFSTCVSHIV

SEQ ID NO: 6835 - protein, 10 aa, Homo Sapiens
QAPAYVHTMI

SEQ ID NO: 6836 - protein, 10 aa, Homo Sapiens
MNPVIYSVKT

SEQ ID NO: 6837 - protein, 10 aa, Homo Sapiens
KQIRRAVIKI

SEQ ID NO: 6838 - protein, 10 aa, Homo Sapiens
YYFLSMLSAT

SEQ ID NO: 6839 - protein, 10 aa, Homo Sapiens
SIFWFNVREI

SEQ ID NO: 6840 - protein, 10 aa, Homo Sapiens
ISFNACLSHM

SEQ ID NO: 6841 - protein, 10 aa, Homo Sapiens
SFNACLSHMF

SEQ ID NO: 6842 - protein, 10 aa, Homo Sapiens
NACLSHMFFI

SEQ ID NO: 6843 - protein, 10 aa, Homo Sapiens
LSHMFFIKFF

SEQ ID NO: 6844 - protein, 10 aa, Homo Sapiens
HMFFIKFFTV

SEQ ID NO: 6845 - protein, 10 aa, Homo Sapiens
KFFTVMESSV

SEQ ID NO: 6846 - protein, 10 aa, Homo Sapiens
YAMILTDSRI

SEQ ID NO: 6847 - protein, 10 aa, Homo Sapiens
GLLMLTPMVA

SEQ ID NO: 6848 - protein, 10 aa, Homo Sapiens
IRLSYCHSQV

SEQ ID NO: 6849 - protein, 10 aa, Homo Sapiens
HSYCYHPDVM

SEQ ID NO: 6850 - protein, 10 aa, Homo Sapiens
MKLSCTDTRI

SEQ ID NO: 6851 - protein, 10 aa, Homo Sapiens
TRINSAVGLT

SEQ ID NO: 6852 - protein, 10 aa, Homo Sapiens
VGLTAMFSTV

SEQ ID NO: 6853 - protein, 10 aa, Homo Sapiens
LIIRTVLSVA

SEQ ID NO: 6854 - protein, 10 aa, Homo Sapiens
PEERKETFST

SEQ ID NO: 6855 - protein, 10 aa, Homo Sapiens
FSTCVSHIVA

SEQ ID NO: 6856 - protein, 10 aa, Homo Sapiens
HIVAFAIYYI

SEQ ID NO: 6857 - protein, 10 aa, Homo Sapiens
NTYLLISPLM

SEQ ID NO: 6858 - protein, 10 aa, Homo Sapiens
LLISPLMNPV

SEQ ID NO: 6859 - protein, 10 aa, Homo Sapiens
PLMNPVIYSV

SEQ ID NO: 6860 - protein, 10 aa, Homo Sapiens
VIYSVKTKQI

SEQ ID NO: 6861 - protein, 10 aa, Homo Sapiens
STLVTMLSIF

SEQ ID NO: 6862 - protein, 10 aa, Homo Sapiens
LVTMLSIFWF

SEQ ID NO: 6863 - protein, 10 aa, Homo Sapiens
TMLSIFWFNV

SEQ ID NO: 6864 - protein, 10 aa, Homo Sapiens
FWFNVREISF

SEQ ID NO: 6865 - protein, 10 aa, Homo Sapiens
FNVREISFNA

SEQ ID NO: 6866 - protein, 10 aa, Homo Sapiens
VAVSNPLRYA

SEQ ID NO: 6867 - protein, 10 aa, Homo Sapiens
AQIGVASVIR

SEQ ID NO: 6868 - protein, 10 aa, Homo Sapiens
SVIRGLLMLT

SEQ ID NO: 6869 - protein, 10 aa, Homo Sapiens
VIRGLLMLTP

SEQ ID NO: 6870 - protein, 10 aa, Homo Sapiens
SCTDTRINSA

SEQ ID NO: 6871 - protein, 10 aa, Homo Sapiens
DLLLILLSYV

SEQ ID NO: 6872 - protein, 10 aa, Homo Sapiens
LSYVLIIRTV

SEQ ID NO: 6873 - protein, 10 aa, Homo Sapiens
IIRTVLSVAS

SEQ ID NO: 6874 - protein, 10 aa, Homo Sapiens
YIPLISLSIV

SEQ ID NO: 6875 - protein, 10 aa, Homo Sapiens
SIVHRFGKQA

SEQ ID NO: 6876 - protein, 10 aa, Homo Sapiens
SVKTKQIRRA

SEQ ID NO: 6877 - protein, 10 aa, Homo Sapiens
VIKILHSKET

SEQ ID NO: 6878 - protein, 10 aa, Homo Sapiens
EISFNACLSH

SEQ ID NO: 6879 - protein, 10 aa, Homo Sapiens
AFDRFVAVSN

SEQ ID NO: 6880 - protein, 10 aa, Homo Sapiens
EERKETFSTC

SEQ ID NO: 6881 - protein, 10 aa, Homo Sapiens
MLSIFWFNVR

SEQ ID NO: 6882 - protein, 10 aa, Homo Sapiens
NVREISFNAC

SEQ ID NO: 6883 - protein, 10 aa, Homo Sapiens
FFIKFFTVME

SEQ ID NO: 6884 - protein, 10 aa, Homo Sapiens
PLRYAMILTD

SEQ ID NO: 6885 - protein, 10 aa, Homo Sapiens
SRIAQIGVAS

SEQ ID NO: 6886 - protein, 10 aa, Homo Sapiens
MVALLIRLSY

SEQ ID NO: 6887 - protein, 10 aa, Homo Sapiens
KLSCTDTRIN

SEQ ID NO: 6888 - protein, 10 aa, Homo Sapiens
HRFGKQAPAY

SEQ ID NO: 6889 - protein, 10 aa, Homo Sapiens
IRRAVIKILH

SEQ ID NO: 6890 - protein, 10 aa, Homo Sapiens
RRAVIKILHS

SEQ ID NO: 6891 - protein, 10 aa, Homo Sapiens
MLSATDLGLS

SEQ ID NO: 6892 - protein, 10 aa, Homo Sapiens
SISTLVTMLS

SEQ ID NO: 6893 - protein, 10 aa, Homo Sapiens
VTMLSIFWFN

SEQ ID NO: 6894 - protein, 10 aa, Homo Sapiens
ACLSHMFFIK

SEQ ID NO: 6895 - protein, 10 aa, Homo Sapiens
MAFDRFVAVS

SEQ ID NO: 6896 - protein, 10 aa, Homo Sapiens
FDRFVAVSNP

SEQ ID NO: 6897 - protein, 10 aa, Homo Sapiens
RFVAVSNPLR

SEQ ID NO: 6898 - protein, 10 aa, Homo Sapiens
FVAVSNPLRY

SEQ ID NO: 6899 - protein, 10 aa, Homo Sapiens
RYAMILTDSR

SEQ ID NO: 6900 - protein, 10 aa, Homo Sapiens
SYCHSQVLHH

SEQ ID NO: 6901 - protein, 10 aa, Homo Sapiens
SAVGLTAMFS

SEQ ID NO: 6902 - protein, 10 aa, Homo Sapiens
GLTAMFSTVG

SEQ ID NO: 6903 - protein, 10 aa, Homo Sapiens
TAMFSTVGVD

SEQ ID NO: 6904 - protein, 10 aa, Homo Sapiens
GVDLLLILLS

SEQ ID NO: 6905 - protein, 10 aa, Homo Sapiens
YVLIIRTVLS

SEQ ID NO: 6906 - protein, 10 aa, Homo Sapiens
IRTVLSVASP

SEQ ID NO: 6907 - protein, 10 aa, Homo Sapiens
RKETFSTCVS

SEQ ID NO: 6908 - protein, 10 aa, Homo Sapiens
KETFSTCVSH

SEQ ID NO: 6909 - protein, 10 aa, Homo Sapiens
SLSIVHRFGK

SEQ ID NO: 6910 - protein, 10 aa, Homo Sapiens
MIANTYLLIS

SEQ ID NO: 6911 - protein, 10 aa, Homo Sapiens
ISPLMNPVIY

SEQ ID NO: 6912 - protein, 10 aa, Homo Sapiens
IYSVKTKQIR

SEQ ID NO: 6913 - protein, 10 aa, Homo Sapiens
AVIKILHSKE

SEQ ID NO: 6914 - protein, 10 aa, Homo Sapiens
LSMLSATDLG

SEQ ID NO: 6915 - protein, 10 aa, Homo Sapiens
LSIFWFNVRE

SEQ ID NO: 6916 - protein, 10 aa, Homo Sapiens
IFWFNVREIS

SEQ ID NO: 6917 - protein, 10 aa, Homo Sapiens
SSVLLAMAFD

SEQ ID NO: 6918 - protein, 10 aa, Homo Sapiens
LRYAMILTDS

SEQ ID NO: 6919 - protein, 10 aa, Homo Sapiens
MILTDSRIAQ

SEQ ID NO: 6920 - protein, 10 aa, Homo Sapiens
QIGVASVIRG

SEQ ID NO: 6921 - protein, 10 aa, Homo Sapiens
LTPMVALLIR

SEQ ID NO: 6922 - protein, 10 aa, Homo Sapiens
ALLIRLSYCH

SEQ ID NO: 6923 - protein, 10 aa, Homo Sapiens
LIRLSYCHSQ

SEQ ID NO: 6924 - protein, 10 aa, Homo Sapiens
LSYCHSQVLH

SEQ ID NO: 6925 - protein, 10 aa, Homo Sapiens
CHSQVLHHSY

SEQ ID NO: 6926 - protein, 10 aa, Homo Sapiens
SYCYHPDVMK

SEQ ID NO: 6927 - protein, 10 aa, Homo Sapiens
YHPDVMKLSC

SEQ ID NO: 6928 - protein, 10 aa, Homo Sapiens
TDTRINSAVG

SEQ ID NO: 6929 - protein, 10 aa, Homo Sapiens
VDLLLILLSY

SEQ ID NO: 6930 - protein, 10 aa, Homo Sapiens
RTVLSVASPE

SEQ ID NO: 6931 - protein, 10 aa, Homo Sapiens
VLSVASPEER

SEQ ID NO: 6932 - protein, 10 aa, Homo Sapiens
VSHIVAFAIY

SEQ ID NO: 6933 - protein, 10 aa, Homo Sapiens
IVAFAIYYIP

SEQ ID NO: 6934 - protein, 10 aa, Homo Sapiens
FAIYYIPLIS

SEQ ID NO: 6935 - protein, 10 aa, Homo Sapiens
PLISLSIVHR

SEQ ID NO: 6936 - protein, 10 aa, Homo Sapiens
ISLSIVHRFG

SEQ ID NO: 6937 - protein, 10 aa, Homo Sapiens
IVHRFGKQAP

SEQ ID NO: 6938 - protein, 10 aa, Homo Sapiens
TYLLISPLMN

SEQ ID NO: 6939 - protein, 10 aa, Homo Sapiens
LMNPVIYSVK

SEQ ID NO: 6940 - protein, 10 aa, Homo Sapiens
TKQIRRAVIK

SEQ ID NO: 6941 - protein, 10 aa, Homo Sapiens
YFLSMLSATD

SEQ ID NO: 6942 - protein, 10 aa, Homo Sapiens
TLVTMLSIFW

SEQ ID NO: 6943 - protein, 10 aa, Homo Sapiens
WFNVREISFN

SEQ ID NO: 6944 - protein, 10 aa, Homo Sapiens
REISFNACLS

SEQ ID NO: 6945 - protein, 10 aa, Homo Sapiens
FIKFFTVMES

SEQ ID NO: 6946 - protein, 10 aa, Homo Sapiens
IKFFTVMESS

SEQ ID NO: 6947 - protein, 10 aa, Homo Sapiens
LTDSRIAQIG

SEQ ID NO: 6948 - protein, 10 aa, Homo Sapiens
PMVALLIRLS

SEQ ID NO: 6949 - protein, 10 aa, Homo Sapiens
LHHSYCYHPD

SEQ ID NO: 6950 - protein, 10 aa, Homo Sapiens
CYHPDVMKLS

SEQ ID NO: 6951 - protein, 10 aa, Homo Sapiens
VMKLSCTDTR

SEQ ID NO: 6952 - protein, 10 aa, Homo Sapiens
LSCTDTRINS

SEQ ID NO: 6953 - protein, 10 aa, Homo Sapiens
ILLSYVLIIR

SEQ ID NO: 6954 - protein, 10 aa, Homo Sapiens
TVLSVASPEE

SEQ ID NO: 6955 - protein, 10 aa, Homo Sapiens
LSVASPEERK

SEQ ID NO: 6956 - protein, 10 aa, Homo Sapiens
SVASPEERKE

SEQ ID NO: 6957 - protein, 10 aa, Homo Sapiens
IYYIPLISLS

SEQ ID NO: 6958 - protein, 10 aa, Homo Sapiens
LSIVHRFGKQ

SEQ ID NO: 6959 - protein, 10 aa, Homo Sapiens
FGKQAPAYVH

SEQ ID NO: 6960 - protein, 10 aa, Homo Sapiens
PAYVHTMIAN

SEQ ID NO: 6961 - protein, 10 aa, Homo Sapiens
IANTYLLISP

SEQ ID NO: 6962 - protein, 10 aa, Homo Sapiens
PVIYSVKTKQ

SEQ ID NO: 6963 - protein, 10 aa, Homo Sapiens
YSVKTKQIRR

SEQ ID NO: 6964 - protein, 10 aa, Homo Sapiens
RAVIKILHSK

SEQ ID NO: 6965 - protein, 10 aa, Homo Sapiens
STCVSHIVAF

SEQ ID NO: 6966 - protein, 10 aa, Homo Sapiens
TDLGLSISTL

SEQ ID NO: 6967 - protein, 10 aa, Homo Sapiens
ESSVLLAMAF

SEQ ID NO: 6968 - protein, 10 aa, Homo Sapiens
AMFSTVGVDL

SEQ ID NO: 6969 - protein, 10 aa, Homo Sapiens
SHIVAFAIYY

SEQ ID NO: 6970 - protein, 10 aa, Homo Sapiens
HRFGKQAPAY

SEQ ID NO: 6971 - protein, 10 aa, Homo Sapiens
ANTYLLISPL

SEQ ID NO: 6972 - protein, 10 aa, Homo Sapiens
KQIRRAVIKI

SEQ ID NO: 6973 - protein, 10 aa, Homo Sapiens
QIRRAVIKIL

SEQ ID NO: 6974 - protein, 10 aa, Homo Sapiens
REISFNACLS

SEQ ID NO: 6975 - protein, 10 aa, Homo Sapiens
LSHMFFIKFF

SEQ ID NO: 6976 - protein, 10 aa, Homo Sapiens
ASVIRGLLML

SEQ ID NO: 6977 - protein, 10 aa, Homo Sapiens
LLMLTPMVAL

SEQ ID NO: 6978 - protein, 10 aa, Homo Sapiens
ASPEERKETF

SEQ ID NO: 6979 - protein, 10 aa, Homo Sapiens
AFAIYYIPLI

SEQ ID NO: 6980 - protein, 10 aa, Homo Sapiens
AIYYIPLISL

SEQ ID NO: 6981 - protein, 10 aa, Homo Sapiens
YYIPLISLSI

SEQ ID NO: 6982 - protein, 10 aa, Homo Sapiens
LSISTLVTML

SEQ ID NO: 6983 - protein, 10 aa, Homo Sapiens
FWFNVREISF

SEQ ID NO: 6984 - protein, 10 aa, Homo Sapiens
CLSHMFFIKF

SEQ ID NO: 6985 - protein, 10 aa, Homo Sapiens
SNPLRYAMIL

SEQ ID NO: 6986 - protein, 10 aa, Homo Sapiens
IGVASVIRGL

SEQ ID NO: 6987 - protein, 10 aa, Homo Sapiens
LMLTPMVALL

SEQ ID NO: 6988 - protein, 10 aa, Homo Sapiens
MLTPMVALLI

SEQ ID NO: 6989 - protein, 10 aa, Homo Sapiens
MFSTVGVDLL

SEQ ID NO: 6990 - protein, 10 aa, Homo Sapiens
VGVDLLLILL

SEQ ID NO: 6991 - protein, 10 aa, Homo Sapiens
VDLLLILLSY

SEQ ID NO: 6992 - protein, 10 aa, Homo Sapiens
LLILLSYVLI

SEQ ID NO: 6993 - protein, 10 aa, Homo Sapiens
SYVLIIRTVL

SEQ ID NO: 6994 - protein, 10 aa, Homo Sapiens
EERKETFSTC

SEQ ID NO: 6995 - protein, 10 aa, Homo Sapiens
LISLSIVHRF

SEQ ID NO: 6996 - protein, 10 aa, Homo Sapiens
YVHTMIANTY

SEQ ID NO: 6997 - protein, 10 aa, Homo Sapiens
ISPLMNPVIY

SEQ ID NO: 6998 - protein, 10 aa, Homo Sapiens
SMLSATDLGL

SEQ ID NO: 6999 - protein, 10 aa, Homo Sapiens
STLVTMLSIF

SEQ ID NO: 7000 - protein, 10 aa, Homo Sapiens
LVTMLSIFWF

SEQ ID NO: 7001 - protein, 10 aa, Homo Sapiens
SIFWFNVREI

SEQ ID NO: 7002 - protein, 10 aa, Homo Sapiens
DRFVAVSNPL

SEQ ID NO: 7003 - protein, 10 aa, Homo Sapiens
ILTDSRIAQI

SEQ ID NO: 7004 - protein, 10 aa, Homo Sapiens
TPMVALLIRL

SEQ ID NO: 7005 - protein, 10 aa, Homo Sapiens
MVALLIRLSY

SEQ ID NO: 7006 - protein, 10 aa, Homo Sapiens
STVGVDLLLI

SEQ ID NO: 7007 - protein, 10 aa, Homo Sapiens
ETFSTCVSHI

SEQ ID NO: 7008 - protein, 10 aa, Homo Sapiens
VAFAIYYIPL

SEQ ID NO: 7009 - protein, 10 aa, Homo Sapiens
HTMIANTYLL

SEQ ID NO: 7010 - protein, 10 aa, Homo Sapiens
TMIANTYLLI

SEQ ID NO: 7011 - protein, 10 aa, Homo Sapiens
LISPLMNPVI

SEQ ID NO: 7012 - protein, 10 aa, Homo Sapiens
FLSMLSATDL

SEQ ID NO: 7013 - protein, 10 aa, Homo Sapiens
TLVTMLSIFW

SEQ ID NO: 7014 - protein, 10 aa, Homo Sapiens
SFNACLSHMF

SEQ ID NO: 7015 - protein, 10 aa, Homo Sapiens
FTVMESSVLL

SEQ ID NO: 7016 - protein, 10 aa, Homo Sapiens
MESSVLLAMA

SEQ ID NO: 7017 - protein, 10 aa, Homo Sapiens
VLLAMAFDRF

SEQ ID NO: 7018 - protein, 10 aa, Homo Sapiens
FVAVSNPLRY

SEQ ID NO: 7019 - protein, 10 aa, Homo Sapiens
GVASVIRGLL

SEQ ID NO: 7020 - protein, 10 aa, Homo Sapiens
RLSYCHSQVL

SEQ ID NO: 7021 - protein, 10 aa, Homo Sapiens
CHSQVLHHSY

SEQ ID NO: 7022 - protein, 10 aa, Homo Sapiens
SQVLHHSYCY

SEQ ID NO: 7023 - protein, 10 aa, Homo Sapiens
YCYHPDVMKL

SEQ ID NO: 7024 - protein, 10 aa, Homo Sapiens
DTRINSAVGL

SEQ ID NO: 7025 - protein, 10 aa, Homo Sapiens
NSAVGLTAMF

SEQ ID NO: 7026 - protein, 10 aa, Homo Sapiens
FSTVGVDLLL

SEQ ID NO: 7027 - protein, 10 aa, Homo Sapiens
TVGVDLLLIL

SEQ ID NO: 7028 - protein, 10 aa, Homo Sapiens
LLLILLSYVL

SEQ ID NO: 7029 - protein, 10 aa, Homo Sapiens
LILLSYVLII

SEQ ID NO: 7030 - protein, 10 aa, Homo Sapiens
PEERKETFST

SEQ ID NO: 7031 - protein, 10 aa, Homo Sapiens
KETFSTCVSH

SEQ ID NO: 7032 - protein, 10 aa, Homo Sapiens
CVSHIVAFAI

SEQ ID NO: 7033 - protein, 10 aa, Homo Sapiens
VIYSVKTKQI

SEQ ID NO: 7034 - protein, 10 aa, Homo Sapiens
FFTVMESSVL

SEQ ID NO: 7035 - protein, 10 aa, Homo Sapiens
VSNPLRYAMI

SEQ ID NO: 7036 - protein, 10 aa, Homo Sapiens
VSHIVAFAIY

SEQ ID NO: 7037 - protein, 10 aa, Homo Sapiens
HIVAFAIYYI

SEQ ID NO: 7038 - protein, 10 aa, Homo Sapiens
KTKQIRRAVI

SEQ ID NO: 7039 - protein, 10 aa, Homo Sapiens
LSATDLGLSI

SEQ ID NO: 7040 - protein, 10 aa, Homo Sapiens
ISTLVTMLSI

SEQ ID NO: 7041 - protein, 10 aa, Homo Sapiens
VREISFNACL

SEQ ID NO: 7042 - protein, 10 aa, Homo Sapiens
FNACLSHMFF

SEQ ID NO: 7043 - protein, 10 aa, Homo Sapiens
NACLSHMFFI

SEQ ID NO: 7044 - protein, 10 aa, Homo Sapiens
IAQIGVASVI

SEQ ID NO: 7045 - protein, 10 aa, Homo Sapiens
VHTMIANTYL

SEQ ID NO: 7046 - protein, 10 aa, Homo Sapiens
YAMILTDSRI

SEQ ID NO: 7047 - protein, 10 aa, Homo Sapiens
MKLSCTDTRI

SEQ ID NO: 7048 - protein, 10 aa, Homo Sapiens
QAPAYVHTMI

SEQ ID NO: 7049 - protein, 10 aa, Homo Sapiens
AVSNPLRYAM

SEQ ID NO: 7050 - protein, 10 aa, Homo Sapiens
AMILTDSRIA

SEQ ID NO: 7051 - protein, 10 aa, Homo Sapiens
AQIGVASVIR

SEQ ID NO: 7052 - protein, 10 aa, Homo Sapiens
AMAFDRFVAV

SEQ ID NO: 7053 - protein, 10 aa, Homo Sapiens
AFDRFVAVSN

SEQ ID NO: 7054 - protein, 10 aa, Homo Sapiens
SRIAQIGVAS

SEQ ID NO: 7055 - protein, 10 aa, Homo Sapiens
SVIRGLLMLT

SEQ ID NO: 7056 - protein, 10 aa, Homo Sapiens
GVDLLLILLS

SEQ ID NO: 7057 - protein, 10 aa, Homo Sapiens
VASPEERKET

SEQ ID NO: 7058 - protein, 10 aa, Homo Sapiens
PLISLSIVHR

SEQ ID NO: 7059 - protein, 10 aa, Homo Sapiens
KQAPAYVHTM

SEQ ID NO: 7060 - protein, 10 aa, Homo Sapiens
AVIKILHSKE

SEQ ID NO: 7061 - protein, 10 aa, Homo Sapiens
YYFLSMLSAT

SEQ ID NO: 7062 - protein, 10 aa, Homo Sapiens
ATDLGLSIST

SEQ ID NO: 7063 - protein, 10 aa, Homo Sapiens
MILTDSRIAQ

SEQ ID NO: 7064 - protein, 10 aa, Homo Sapiens
CYHPDVMKLS

SEQ ID NO: 7065 - protein, 10 aa, Homo Sapiens
SCTDTRINSA

SEQ ID NO: 7066 - protein, 10 aa, Homo Sapiens
TRINSAVGLT

SEQ ID NO: 7067 - protein, 10 aa, Homo Sapiens
LIIRTVLSVA

SEQ ID NO: 7068 - protein, 10 aa, Homo Sapiens
AYVHTMIANT

SEQ ID NO: 7069 - protein, 10 aa, Homo Sapiens
SVKTKQIRRA

SEQ ID NO: 7070 - protein, 10 aa, Homo Sapiens
SISTLVTMLS

SEQ ID NO: 7071 - protein, 10 aa, Homo Sapiens
NVREISFNAC

SEQ ID NO: 7072 - protein, 10 aa, Homo Sapiens
ACLSHMFFIK

SEQ ID NO: 7073 - protein, 10 aa, Homo Sapiens
FFIKFFTVME

SEQ ID NO: 7074 - protein, 10 aa, Homo Sapiens
MAFDRFVAVS

SEQ ID NO: 7075 - protein, 10 aa, Homo Sapiens
NPLRYAMILT

SEQ ID NO: 7076 - protein, 10 aa, Homo Sapiens
PLRYAMILTD

SEQ ID NO: 7077 - protein, 10 aa, Homo Sapiens
PMVALLIRLS

SEQ ID NO: 7078 - protein, 10 aa, Homo Sapiens
LLSYVLIIRT

SEQ ID NO: 7079 - protein, 10 aa, Homo Sapiens
LSYVLIIRTV

SEQ ID NO: 7080 - protein, 10 aa, Homo Sapiens
VLIIRTVLSV

SEQ ID NO: 7081 - protein, 10 aa, Homo Sapiens
FAIYYIPLIS

SEQ ID NO: 7082 - protein, 10 aa, Homo Sapiens
LSIVHRFGKQ

SEQ ID NO: 7083 - protein, 10 aa, Homo Sapiens
PLMNPVIYSV

SEQ ID NO: 7084 - protein, 10 aa, Homo Sapiens
NPVIYSVKTK

SEQ ID NO: 7085 - protein, 10 aa, Homo Sapiens
LSMLSATDLG

SEQ ID NO: 7086 - protein, 10 aa, Homo Sapiens
LGLSISTLVT

SEQ ID NO: 7087 - protein, 10 aa, Homo Sapiens
GLSISTLVTM

SEQ ID NO: 7088 - protein, 10 aa, Homo Sapiens
MLSIFWFNVR

SEQ ID NO: 7089 - protein, 10 aa, Homo Sapiens
LSIFWFNVRE

SEQ ID NO: 7090 - protein, 10 aa, Homo Sapiens
EISFNACLSH

SEQ ID NO: 7091 - protein, 10 aa, Homo Sapiens
ISFNACLSHM

SEQ ID NO: 7092 - protein, 10 aa, Homo Sapiens
HMFFIKFFTV

SEQ ID NO: 7093 - protein, 10 aa, Homo Sapiens
MFFIKFFTVM

SEQ ID NO: 7094 - protein, 10 aa, Homo Sapiens
KFFTVMESSV

SEQ ID NO: 7095 - protein, 10 aa, Homo Sapiens
TVMESSVLLA

SEQ ID NO: 7096 - protein, 10 aa, Homo Sapiens
VMESSVLLAM

SEQ ID NO: 7097 - protein, 10 aa, Homo Sapiens
SVLLAMAFDR

SEQ ID NO: 7098 - protein, 10 aa, Homo Sapiens
DSRIAQIGVA

SEQ ID NO: 7099 - protein, 10 aa, Homo Sapiens
ALLIRLSYCH

SEQ ID NO: 7100 - protein, 10 aa, Homo Sapiens
LLIRLSYCHS

SEQ ID NO: 7101 - protein, 10 aa, Homo Sapiens
KLSCTDTRIN

SEQ ID NO: 7102 - protein, 10 aa, Homo Sapiens
CTDTRINSAV

SEQ ID NO: 7103 - protein, 10 aa, Homo Sapiens
INSAVGLTAM

SEQ ID NO: 7104 - protein, 10 aa, Homo Sapiens
AVGLTAMFST

SEQ ID NO: 7105 - protein, 10 aa, Homo Sapiens
VGLTAMFSTV

SEQ ID NO: 7106 - protein, 10 aa, Homo Sapiens
YVLIIRTVLS

SEQ ID NO: 7107 - protein, 10 aa, Homo Sapiens
IIRTVLSVAS

SEQ ID NO: 7108 - protein, 10 aa, Homo Sapiens
IYYIPLISLS

SEQ ID NO: 7109 - protein, 10 aa, Homo Sapiens
SIVHRFGKQA

SEQ ID NO: 7110 - protein, 10 aa, Homo Sapiens
APAYVHTMIA

SEQ ID NO: 7111 - protein, 10 aa, Homo Sapiens
TYLLISPLMN

SEQ ID NO: 7112 - protein, 10 aa, Homo Sapiens
LLISPLMNPV

SEQ ID NO: 7113 - protein, 10 aa, Homo Sapiens
SPLMNPVIYS

SEQ ID NO: 7114 - protein, 10 aa, Homo Sapiens
LMNPVIYSVK

SEQ ID NO: 7115 - protein, 10 aa, Homo Sapiens
PVIYSVKTKQ

SEQ ID NO: 7116 - protein, 10 aa, Homo Sapiens
VKTKQIRRAV

SEQ ID NO: 7117 - protein, 10 aa, Homo Sapiens
RRAVIKILHS

SEQ ID NO: 7118 - protein, 10 aa, Homo Sapiens
MLSATDLGLS

SEQ ID NO: 7119 - protein, 10 aa, Homo Sapiens
SATDLGLSIS

SEQ ID NO: 7120 - protein, 10 aa, Homo Sapiens
VTMLSIFWFN

SEQ ID NO: 7121 - protein, 10 aa, Homo Sapiens
WFNVREISFN

SEQ ID NO: 7122 - protein, 10 aa, Homo Sapiens
LAMAFDRFVA

SEQ ID NO: 7123 - protein, 10 aa, Homo Sapiens
TDSRIAQIGV

SEQ ID NO: 7124 - protein, 10 aa, Homo Sapiens
VASVIRGLLM

SEQ ID NO: 7125 - protein, 10 aa, Homo Sapiens
VIRGLLMLTP

SEQ ID NO: 7126 - protein, 10 aa, Homo Sapiens
RGLLMLTPMV

SEQ ID NO: 7127 - protein, 10 aa, Homo Sapiens
GLLMLTPMVA

SEQ ID NO: 7128 - protein, 10 aa, Homo Sapiens
LTPMVALLIR

SEQ ID NO: 7129 - protein, 10 aa, Homo Sapiens
VALLIRLSYC

SEQ ID NO: 7130 - protein, 10 aa, Homo Sapiens
SYCHSQVLHH

SEQ ID NO: 7131 - protein, 10 aa, Homo Sapiens
YHPDVMKLSC

SEQ ID NO: 7132 - protein, 10 aa, Homo Sapiens
VMKLSCTDTR

SEQ ID NO: 7133 - protein, 10 aa, Homo Sapiens
LSCTDTRINS

SEQ ID NO: 7134 - protein, 10 aa, Homo Sapiens
SAVGLTAMFS

SEQ ID NO: 7135 - protein, 10 aa, Homo Sapiens
TAMFSTVGVD

SEQ ID NO: 7136 - protein, 10 aa, Homo Sapiens
DLLLILLSYV

SEQ ID NO: 7137 - protein, 10 aa, Homo Sapiens
ILLSYVLIIR

SEQ ID NO: 7138 - protein, 10 aa, Homo Sapiens
SVASPEERKE

SEQ ID NO: 7139 - protein, 10 aa, Homo Sapiens
RKETFSTCVS

SEQ ID NO: 7140 - protein, 10 aa, Homo Sapiens
TFSTCVSHIV

SEQ ID NO: 7141 - protein, 10 aa, Homo Sapiens
YIPLISLSIV

SEQ ID NO: 7142 - protein, 10 aa, Homo Sapiens
IPLISLSIVH

SEQ ID NO: 7143 - protein, 10 aa, Homo Sapiens
SLSIVHRFGK

SEQ ID NO: 7144 - protein, 10 aa, Homo Sapiens
IVHRFGKQAP

SEQ ID NO: 7145 - protein, 10 aa, Homo Sapiens
PAYVHTMIAN

SEQ ID NO: 7146 - protein, 10 aa, Homo Sapiens
MIANTYLLIS

SEQ ID NO: 7147 - protein, 10 aa, Homo Sapiens
IANTYLLISP

SEQ ID NO: 7148 - protein, 10 aa, Homo Sapiens
NTYLLISPLM

SEQ ID NO: 7149 - protein, 10 aa, Homo Sapiens
MNPVIYSVKT

SEQ ID NO: 7150 - protein, 10 aa, Homo Sapiens
YFLSMLSATD

SEQ ID NO: 7151 - protein, 10 aa, Homo Sapiens
DLGLSISTLV

SEQ ID NO: 7152 - protein, 10 aa, Homo Sapiens
SHMFFIKFFT

SEQ ID NO: 7153 - protein, 10 aa, Homo Sapiens
IKFFTVMESS

SEQ ID NO: 7154 - protein, 10 aa, Homo Sapiens
SSVLLAMAFD

SEQ ID NO: 7155 - protein, 10 aa, Homo Sapiens
VAVSNPLRYA

SEQ ID NO: 7156 - protein, 10 aa, Homo Sapiens
LTDSRIAQIG

SEQ ID NO: 7157 - protein, 10 aa, Homo Sapiens
QIGVASVIRG

SEQ ID NO: 7158 - protein, 10 aa, Homo Sapiens
IRGLLMLTPM

SEQ ID NO: 7159 - protein, 10 aa, Homo Sapiens
LIRLSYCHSQ

SEQ ID NO: 7160 - protein, 10 aa, Homo Sapiens
IRLSYCHSQV

SEQ ID NO: 7161 - protein, 10 aa, Homo Sapiens
LSYCHSQVLH

SEQ ID NO: 7162 - protein, 10 aa, Homo Sapiens
YCHSQVLHHS

SEQ ID NO: 7163 - protein, 10 aa, Homo Sapiens
HSYCYHPDVM

SEQ ID NO: 7164 - protein, 10 aa, Homo Sapiens
SYCYHPDVMK

SEQ ID NO: 7165 - protein, 10 aa, Homo Sapiens
HPDVMKLSCT

SEQ ID NO: 7166 - protein, 10 aa, Homo Sapiens
TDTRINSAVG

SEQ ID NO: 7167 - protein, 10 aa, Homo Sapiens
RINSAVGLTA

SEQ ID NO: 7168 - protein, 10 aa, Homo Sapiens
LTAMFSTVGV

SEQ ID NO: 7169 - protein, 10 aa, Homo Sapiens
RTVLSVASPE

SEQ ID NO: 7170 - protein, 10 aa, Homo Sapiens
VLSVASPEER

SEQ ID NO: 7171 - protein, 10 aa, Homo Sapiens
ERKETFSTCV

SEQ ID NO: 7172 - protein, 10 aa, Homo Sapiens
FSTCVSHIVA

SEQ ID NO: 7173 - protein, 10 aa, Homo Sapiens
ISLSIVHRFG

SEQ ID NO: 7174 - protein, 10 aa, Homo Sapiens
FGKQAPAYVH

SEQ ID NO: 7175 - protein, 10 aa, Homo Sapiens
YLLISPLMNP

SEQ ID NO: 7176 - protein, 10 aa, Homo Sapiens
TKQIRRAVIK

SEQ ID NO: 7177 - protein, 10 aa, Homo Sapiens
IRRAVIKILH

SEQ ID NO: 7178 - protein, 10 aa, Homo Sapiens
RAVIKILHSK

SEQ ID NO: 7179 - protein, 10 aa, Homo Sapiens
VIKILHSKET

SEQ ID NO: 7180 - protein, 10 aa, Homo Sapiens
MYYFLSMLSA

SEQ ID NO: 7181 - protein, 10 aa, Homo Sapiens
TMLSIFWFNV

SEQ ID NO: 7182 - protein, 10 aa, Homo Sapiens
IFWFNVREIS

SEQ ID NO: 7183 - protein, 10 aa, Homo Sapiens
FNVREISFNA

SEQ ID NO: 7184 - protein, 10 aa, Homo Sapiens
FIKFFTVMES

SEQ ID NO: 7185 - protein, 10 aa, Homo Sapiens
LLAMAFDRFV

SEQ ID NO: 7186 - protein, 10 aa, Homo Sapiens
FDRFVAVSNP

SEQ ID NO: 7187 - protein, 10 aa, Homo Sapiens
RFVAVSNPLR

SEQ ID NO: 7188 - protein, 10 aa, Homo Sapiens
LRYAMILTDS

SEQ ID NO: 7189 - protein, 10 aa, Homo Sapiens
RYAMILTDSR

SEQ ID NO: 7190 - protein, 10 aa, Homo Sapiens
RIAQIGVASV

SEQ ID NO: 7191 - protein, 10 aa, Homo Sapiens
QVLHHSYCYH

SEQ ID NO: 7192 - protein, 10 aa, Homo Sapiens
LHHSYCYHPD

SEQ ID NO: 7193 - protein, 10 aa, Homo Sapiens
HHSYCYHPDV

SEQ ID NO: 7194 - protein, 10 aa, Homo Sapiens
PDVMKLSCTD

SEQ ID NO: 7195 - protein, 10 aa, Homo Sapiens
SLHEPMYYFL

SEQ ID NO: 7196 - protein, 10 aa, Homo Sapiens
NITSTSIIFL

SEQ ID NO: 7197 - protein, 10 aa, Homo Sapiens
LLGNSLILFA

SEQ ID NO: 7198 - protein, 10 aa, Homo Sapiens
TLQNITSTSI

SEQ ID NO: 7199 - protein, 10 aa, Homo Sapiens
ITSTSIIFLL

SEQ ID NO: 7200 - protein, 10 aa, Homo Sapiens
IFLLTGVPGL

SEQ ID NO: 7201 - protein, 10 aa, Homo Sapiens
LLTGVPGLEA

SEQ ID NO: 7202 - protein, 10 aa, Homo Sapiens
ALLGNSLILF

SEQ ID NO: 7203 - protein, 10 aa, Homo Sapiens
ISIPFCFLSV

SEQ ID NO: 7204 - protein, 10 aa, Homo Sapiens
SVTALLGNSL

SEQ ID NO: 7205 - protein, 10 aa, Homo Sapiens
TSIIFLLTGV

SEQ ID NO: 7206 - protein, 10 aa, Homo Sapiens
SIPFCFLSVT

SEQ ID NO: 7207 - protein, 10 aa, Homo Sapiens
FLSVTALLGN

SEQ ID NO: 7208 - protein, 10 aa, Homo Sapiens
TALLGNSLIL

SEQ ID NO: 7209 - protein, 10 aa, Homo Sapiens
LFATITQPSL

SEQ ID NO: 7210 - protein, 10 aa, Homo Sapiens
SLILFATITQ

SEQ ID NO: 7211 - protein, 10 aa, Homo Sapiens
VTALLGNSLI

SEQ ID NO: 7212 - protein, 10 aa, Homo Sapiens
LILFATITQP

SEQ ID NO: 7213 - protein, 10 aa, Homo Sapiens
FCFLSVTALL

SEQ ID NO: 7214 - protein, 10 aa, Homo Sapiens
TITQPSLHEP

SEQ ID NO: 7215 - protein, 10 aa, Homo Sapiens
FITSTLQNIT

SEQ ID NO: 7216 - protein, 10 aa, Homo Sapiens
STSIIFLLTG

SEQ ID NO: 7217 - protein, 10 aa, Homo Sapiens
IIFLLTGVPG

SEQ ID NO: 7218 - protein, 10 aa, Homo Sapiens
FLLTGVPGLE

SEQ ID NO: 7219 - protein, 10 aa, Homo Sapiens
LEAFHTWISI

SEQ ID NO: 7220 - protein, 10 aa, Homo Sapiens
GNSLILFATI

SEQ ID NO: 7221 - protein, 10 aa, Homo Sapiens
ILFATITQPS

SEQ ID NO: 7222 - protein, 10 aa, Homo Sapiens
TWISIPFCFL

SEQ ID NO: 7223 - protein, 10 aa, Homo Sapiens
LGNSLILFAT

SEQ ID NO: 7224 - protein, 10 aa, Homo Sapiens
ITQPSLHEPM

SEQ ID NO: 7225 - protein, 10 aa, Homo Sapiens
LQNITSTSII

SEQ ID NO: 7226 - protein, 10 aa, Homo Sapiens
SIIFLLTGVP

SEQ ID NO: 7227 - protein, 10 aa, Homo Sapiens
LTGVPGLEAF

SEQ ID NO: 7228 - protein, 10 aa, Homo Sapiens
GVPGLEAFHT

SEQ ID NO: 7229 - protein, 10 aa, Homo Sapiens
IPFCFLSVTA

SEQ ID NO: 7230 - protein, 10 aa, Homo Sapiens
PFCFLSVTAL

SEQ ID NO: 7231 - protein, 10 aa, Homo Sapiens
EPMYYFLSML

SEQ ID NO: 7232 - protein, 10 aa, Homo Sapiens
STLQNITSTS

SEQ ID NO: 7233 - protein, 10 aa, Homo Sapiens
GLEAFHTWIS

SEQ ID NO: 7234 - protein, 10 aa, Homo Sapiens
TSTLQNITST

SEQ ID NO: 7235 - protein, 10 aa, Homo Sapiens
PGLEAFHTWI

SEQ ID NO: 7236 - protein, 10 aa, Homo Sapiens
ATITQPSLHE

SEQ ID NO: 7237 - protein, 10 aa, Homo Sapiens
ITSTLQNITS

SEQ ID NO: 7238 - protein, 10 aa, Homo Sapiens
WISIPFCFLS

SEQ ID NO: 7239 - protein, 10 aa, Homo Sapiens
HEPMYYFLSM

SEQ ID NO: 7240 - protein, 10 aa, Homo Sapiens
EAFHTWISIP

SEQ ID NO: 7241 - protein, 10 aa, Homo Sapiens
LSVTALLGNS

SEQ ID NO: 7242 - protein, 10 aa, Homo Sapiens
NSLILFATIT

SEQ ID NO: 7243 - protein, 10 aa, Homo Sapiens
FHTWISIPFC

SEQ ID NO: 7244 - protein, 10 aa, Homo Sapiens
HTWISIPFCF

SEQ ID NO: 7245 - protein, 10 aa, Homo Sapiens
PMYYFLSMLS

SEQ ID NO: 7246 - protein, 10 aa, Homo Sapiens
TSTSIIFLLT

SEQ ID NO: 7247 - protein, 10 aa, Homo Sapiens
TGVPGLEAFH

SEQ ID NO: 7248 - protein, 10 aa, Homo Sapiens
VPGLEAFHTW

SEQ ID NO: 7249 - protein, 10 aa, Homo Sapiens
FATITQPSLH

SEQ ID NO: 7250 - protein, 10 aa, Homo Sapiens
CFLSVTALLG

SEQ ID NO: 7251 - protein, 10 aa, Homo Sapiens
LHEPMYYFLS

SEQ ID NO: 7252 - protein, 10 aa, Homo Sapiens
QNITSTSIIF

SEQ ID NO: 7253 - protein, 10 aa, Homo Sapiens
AFHTWISIPF

SEQ ID NO: 7254 - protein, 10 aa, Homo Sapiens
TQPSLHEPMY

SEQ ID NO: 7255 - protein, 10 aa, Homo Sapiens
LEAFHTWISI

SEQ ID NO: 7256 - protein, 10 aa, Homo Sapiens
VTALLGNSLI

SEQ ID NO: 7257 - protein, 10 aa, Homo Sapiens
LFATITQPSL

SEQ ID NO: 7258 - protein, 10 aa, Homo Sapiens
EAFHTWISIP

SEQ ID NO: 7259 - protein, 10 aa, Homo Sapiens
TALLGNSLIL

SEQ ID NO: 7260 - protein, 10 aa, Homo Sapiens
FATITQPSLH

SEQ ID NO: 7261 - protein, 10 aa, Homo Sapiens
AFHTWISIPF

SEQ ID NO: 7262 - protein, 10 aa, Homo Sapiens
ALLGNSLILF

SEQ ID NO: 7263 - protein, 10 aa, Homo Sapiens
ATITQPSLHE

SEQ ID NO: 7264 - protein, 10 aa, Homo Sapiens
LLTGVPGLEA

SEQ ID NO: 7265 - protein, 10 aa, Homo Sapiens
IPFCFLSVTA

SEQ ID NO: 7266 - protein, 10 aa, Homo Sapiens
LLGNSLILFA

SEQ ID NO: 7267 - protein, 10 aa, Homo Sapiens
LTGVPGLEAF

SEQ ID NO: 7268 - protein, 10 aa, Homo Sapiens
PFCFLSVTAL

SEQ ID NO: 7269 - protein, 10 aa, Homo Sapiens
LGNSLILFAT

SEQ ID NO: 7270 - protein, 10 aa, Homo Sapiens
TGVPGLEAFH

SEQ ID NO: 7271 - protein, 10 aa, Homo Sapiens
FCFLSVTALL

SEQ ID NO: 7272 - protein, 10 aa, Homo Sapiens
GNSLILFATI

SEQ ID NO: 7273 - protein, 10 aa, Homo Sapiens
ISIPFCFLSV

SEQ ID NO: 7274 - protein, 10 aa, Homo Sapiens
TQPSLHEPMY

SEQ ID NO: 7275 - protein, 10 aa, Homo Sapiens
LHEPMYYFLS

SEQ ID NO: 7276 - protein, 10 aa, Homo Sapiens
TSTSIIFLLT

SEQ ID NO: 7277 - protein, 10 aa, Homo Sapiens
QPSLHEPMYY

SEQ ID NO: 7278 - protein, 10 aa, Homo Sapiens
STSIIFLLTG

SEQ ID NO: 7279 - protein, 10 aa, Homo Sapiens
ATITQPSLHE

SEQ ID NO: 7280 - protein, 10 aa, Homo Sapiens
ITSTLQNITS

SEQ ID NO: 7281 - protein, 10 aa, Homo Sapiens
GLEAFHTWIS

SEQ ID NO: 7282 - protein, 10 aa, Homo Sapiens
VTALLGNSLI

SEQ ID NO: 7283 - protein, 10 aa, Homo Sapiens
ITQPSLHEPM

SEQ ID NO: 7284 - protein, 10 aa, Homo Sapiens
LLTGVPGLEA

SEQ ID NO: 7285 - protein, 10 aa, Homo Sapiens
ALLGNSLILF

SEQ ID NO: 7286 - protein, 10 aa, Homo Sapiens
HEPMYYFLSM

SEQ ID NO: 7287 - protein, 10 aa, Homo Sapiens
STLQNITSTS

SEQ ID NO: 7288 - protein, 10 aa, Homo Sapiens
ITSTSIIFLL

SEQ ID NO: 7289 - protein, 10 aa, Homo Sapiens
CFLSVTALLG

SEQ ID NO: 7290 - protein, 10 aa, Homo Sapiens
FLSVTALLGN

SEQ ID NO: 7291 - protein, 10 aa, Homo Sapiens
LLGNSLILFA

SEQ ID NO: 7292 - protein, 10 aa, Homo Sapiens
SLILFATITQ

SEQ ID NO: 7293 - protein, 10 aa, Homo Sapiens
LTGVPGLEAF

SEQ ID NO: 7294 - protein, 10 aa, Homo Sapiens
HTWISIPFCF

SEQ ID NO: 7295 - protein, 10 aa, Homo Sapiens
TALLGNSLIL

SEQ ID NO: 7296 - protein, 10 aa, Homo Sapiens
AFHTWISIPF

SEQ ID NO: 7297 - protein, 10 aa, Homo Sapiens
TSTLQNITST

SEQ ID NO: 7298 - protein, 10 aa, Homo Sapiens
QNITSTSIIF

SEQ ID NO: 7299 - protein, 10 aa, Homo Sapiens
NITSTSIIFL

SEQ ID NO: 7300 - protein, 10 aa, Homo Sapiens
TSIIFLLTGV

SEQ ID NO: 7301 - protein, 10 aa, Homo Sapiens
FLLTGVPGLE

SEQ ID NO: 7302 - protein, 10 aa, Homo Sapiens
TGVPGLEAFH

SEQ ID NO: 7303 - protein, 10 aa, Homo Sapiens
VPGLEAFHTW

SEQ ID NO: 7304 - protein, 10 aa, Homo Sapiens
LEAFHTWISI

SEQ ID NO: 7305 - protein, 10 aa, Homo Sapiens
LSVTALLGNS

SEQ ID NO: 7306 - protein, 10 aa, Homo Sapiens
NSLILFATIT

SEQ ID NO: 7307 - protein, 10 aa, Homo Sapiens
PSLHEPMYYF

SEQ ID NO: 7308 - protein, 10 aa, Homo Sapiens
SIIFLLTGVP

SEQ ID NO: 7309 - protein, 10 aa, Homo Sapiens
TWISIPFCFL

SEQ ID NO: 7310 - protein, 10 aa, Homo Sapiens
SIPFCFLSVT

SEQ ID NO: 7311 - protein, 10 aa, Homo Sapiens
FCFLSVTALL

SEQ ID NO: 7312 - protein, 10 aa, Homo Sapiens
SVTALLGNSL

SEQ ID NO: 7313 - protein, 10 aa, Homo Sapiens
GNSLILFATI

SEQ ID NO: 7314 - protein, 10 aa, Homo Sapiens
FATITQPSLH

SEQ ID NO: 7315 - protein, 10 aa, Homo Sapiens
SLHEPMYYFL

SEQ ID NO: 7316 - protein, 10 aa, Homo Sapiens
WISIPFCFLS

SEQ ID NO: 7317 - protein, 10 aa, Homo Sapiens
PMYYFLSMLS

SEQ ID NO: 7318 - protein, 10 aa, Homo Sapiens
FITSTLQNIT

SEQ ID NO: 7319 - protein, 10 aa, Homo Sapiens
TLQNITSTSI

SEQ ID NO: 7320 - protein, 10 aa, Homo Sapiens
IIFLLTGVPG

SEQ ID NO: 7321 - protein, 10 aa, Homo Sapiens
IFLLTGVPGL

SEQ ID NO: 7322 - protein, 10 aa, Homo Sapiens
GVPGLEAFHT

SEQ ID NO: 7323 - protein, 10 aa, Homo Sapiens
FHTWISIPFC

SEQ ID NO: 7324 - protein, 10 aa, Homo Sapiens
PFCFLSVTAL

SEQ ID NO: 7325 - protein, 10 aa, Homo Sapiens
ILFATITQPS

SEQ ID NO: 7326 - protein, 10 aa, Homo Sapiens
EPMYYFLSML

SEQ ID NO: 7327 - protein, 10 aa, Homo Sapiens
LTGVPGLEAF

SEQ ID NO: 7328 - protein, 10 aa, Homo Sapiens
ALLGNSLILF

SEQ ID NO: 7329 - protein, 10 aa, Homo Sapiens
NITSTSIIFL

SEQ ID NO: 7330 - protein, 10 aa, Homo Sapiens
ITSTSIIFLL

SEQ ID NO: 7331 - protein, 10 aa, Homo Sapiens
SLHEPMYYFL

SEQ ID NO: 7332 - protein, 10 aa, Homo Sapiens
IFLLTGVPGL

SEQ ID NO: 7333 - protein, 10 aa, Homo Sapiens
HTWISIPFCF

SEQ ID NO: 7334 - protein, 10 aa, Homo Sapiens
ITQPSLHEPM

SEQ ID NO: 7335 - protein, 10 aa, Homo Sapiens
EPMYYFLSML

SEQ ID NO: 7336 - protein, 10 aa, Homo Sapiens
PFCFLSVTAL

SEQ ID NO: 7337 - protein, 10 aa, Homo Sapiens
SVTALLGNSL

SEQ ID NO: 7338 - protein, 10 aa, Homo Sapiens
LFATITQPSL

SEQ ID NO: 7339 - protein, 10 aa, Homo Sapiens
AFHTWISIPF

SEQ ID NO: 7340 - protein, 10 aa, Homo Sapiens
SIPFCFLSVT

SEQ ID NO: 7341 - protein, 10 aa, Homo Sapiens
TITQPSLHEP

SEQ ID NO: 7342 - protein, 10 aa, Homo Sapiens
TWISIPFCFL

SEQ ID NO: 7343 - protein, 10 aa, Homo Sapiens
LILFATITQP

SEQ ID NO: 7344 - protein, 10 aa, Homo Sapiens
STSIIFLLTG

SEQ ID NO: 7345 - protein, 10 aa, Homo Sapiens
GVPGLEAFHT

SEQ ID NO: 7346 - protein, 10 aa, Homo Sapiens
TQPSLHEPMY

SEQ ID NO: 7347 - protein, 10 aa, Homo Sapiens
PSLHEPMYYF

SEQ ID NO: 7348 - protein, 10 aa, Homo Sapiens
HEPMYYFLSM

SEQ ID NO: 7349 - protein, 10 aa, Homo Sapiens
IIFLLTGVPG

SEQ ID NO: 7350 - protein, 10 aa, Homo Sapiens
EAFHTWISIP

SEQ ID NO: 7351 - protein, 10 aa, Homo Sapiens
FLSVTALLGN

SEQ ID NO: 7352 - protein, 10 aa, Homo Sapiens
ATITQPSLHE

SEQ ID NO: 7353 - protein, 10 aa, Homo Sapiens
STLQNITSTS

SEQ ID NO: 7354 - protein, 10 aa, Homo Sapiens
QNITSTSIIF

SEQ ID NO: 7355 - protein, 10 aa, Homo Sapiens
SIIFLLTGVP

SEQ ID NO: 7356 - protein, 10 aa, Homo Sapiens
VTALLGNSLI

SEQ ID NO: 7357 - protein, 10 aa, Homo Sapiens
LLGNSLILFA

SEQ ID NO: 7358 - protein, 10 aa, Homo Sapiens
FITSTLQNIT

SEQ ID NO: 7359 - protein, 10 aa, Homo Sapiens
LLTGVPGLEA

SEQ ID NO: 7360 - protein, 10 aa, Homo Sapiens
FCFLSVTALL

SEQ ID NO: 7361 - protein, 10 aa, Homo Sapiens
ILFATITQPS

SEQ ID NO: 7362 - protein, 10 aa, Homo Sapiens
QPSLHEPMYY

SEQ ID NO: 7363 - protein, 10 aa, Homo Sapiens
ITSTLQNITS

SEQ ID NO: 7364 - protein, 10 aa, Homo Sapiens
WISIPFCFLS

SEQ ID NO: 7365 - protein, 10 aa, Homo Sapiens
SLILFATITQ

SEQ ID NO: 7366 - protein, 10 aa, Homo Sapiens
TLQNITSTSI

SEQ ID NO: 7367 - protein, 10 aa, Homo Sapiens
ISIPFCFLSV

SEQ ID NO: 7368 - protein, 10 aa, Homo Sapiens
FLLTGVPGLE

SEQ ID NO: 7369 - protein, 10 aa, Homo Sapiens
GLEAFHTWIS

SEQ ID NO: 7370 - protein, 10 aa, Homo Sapiens
TALLGNSLIL

SEQ ID NO: 7371 - protein, 10 aa, Homo Sapiens
TSIIFLLTGV

SEQ ID NO: 7372 - protein, 10 aa, Homo Sapiens
CFLSVTALLG

SEQ ID NO: 7373 - protein, 10 aa, Homo Sapiens
LGNSLILFAT

SEQ ID NO: 7374 - protein, 10 aa, Homo Sapiens
LHEPMYYFLS

SEQ ID NO: 7375 - protein, 10 aa, Homo Sapiens
TSTLQNITST

SEQ ID NO: 7376 - protein, 10 aa, Homo Sapiens
TSTSIIFLLT

SEQ ID NO: 7377 - protein, 10 aa, Homo Sapiens
FHTWISIPFC

SEQ ID NO: 7378 - protein, 10 aa, Homo Sapiens
LSVTALLGNS

SEQ ID NO: 7379 - protein, 10 aa, Homo Sapiens
ALLGNSLILF

SEQ ID NO: 7380 - protein, 10 aa, Homo Sapiens
SLILFATITQ

SEQ ID NO: 7381 - protein, 10 aa, Homo Sapiens
IIFLLTGVPG

SEQ ID NO: 7382 - protein, 10 aa, Homo Sapiens
LLTGVPGLEA

SEQ ID NO: 7383 - protein, 10 aa, Homo Sapiens
SVTALLGNSL

SEQ ID NO: 7384 - protein, 10 aa, Homo Sapiens
SIIFLLTGVP

SEQ ID NO: 7385 - protein, 10 aa, Homo Sapiens
SIPFCFLSVT

SEQ ID NO: 7386 - protein, 10 aa, Homo Sapiens
GVPGLEAFHT

SEQ ID NO: 7387 - protein, 10 aa, Homo Sapiens
TLQNITSTSI

SEQ ID NO: 7388 - protein, 10 aa, Homo Sapiens
FLLTGVPGLE

SEQ ID NO: 7389 - protein, 10 aa, Homo Sapiens
LLGNSLILFA

SEQ ID NO: 7390 - protein, 10 aa, Homo Sapiens
LILFATITQP

SEQ ID NO: 7391 - protein, 10 aa, Homo Sapiens
ILFATITQPS

SEQ ID NO: 7392 - protein, 10 aa, Homo Sapiens
ISIPFCFLSV

SEQ ID NO: 7393 - protein, 10 aa, Homo Sapiens
FLSVTALLGN

SEQ ID NO: 7394 - protein, 10 aa, Homo Sapiens
GLEAFHTWIS

SEQ ID NO: 7395 - protein, 10 aa, Homo Sapiens
SLHEPMYYFL

SEQ ID NO: 7396 - protein, 10 aa, Homo Sapiens
QPSLHEPMYY

SEQ ID NO: 7397 - protein, 10 aa, Homo Sapiens
STLQNITSTS

SEQ ID NO: 7398 - protein, 10 aa, Homo Sapiens
TGVPGLEAFH

SEQ ID NO: 7399 - protein, 10 aa, Homo Sapiens
IPFCFLSVTA

SEQ ID NO: 7400 - protein, 10 aa, Homo Sapiens
QNITSTSIIF

SEQ ID NO: 7401 - protein, 10 aa, Homo Sapiens
STSIIFLLTG

SEQ ID NO: 7402 - protein, 10 aa, Homo Sapiens
WISIPFCFLS

SEQ ID NO: 7403 - protein, 10 aa, Homo Sapiens
FATITQPSLH

SEQ ID NO: 7404 - protein, 10 aa, Homo Sapiens
ATITQPSLHE

SEQ ID NO: 7405 - protein, 10 aa, Homo Sapiens
FITSTLQNIT

SEQ ID NO: 7406 - protein, 10 aa, Homo Sapiens
NITSTSIIFL

SEQ ID NO: 7407 - protein, 10 aa, Homo Sapiens
CFLSVTALLG

SEQ ID NO: 7408 - protein, 10 aa, Homo Sapiens
GNSLILFATI

SEQ ID NO: 7409 - protein, 10 aa, Homo Sapiens
TITQPSLHEP

SEQ ID NO: 7410 - protein, 10 aa, Homo Sapiens
AFHTWISIPF

SEQ ID NO: 7411 - protein, 10 aa, Homo Sapiens
NSLILFATIT

SEQ ID NO: 7412 - protein, 10 aa, Homo Sapiens
TQPSLHEPMY

SEQ ID NO: 7413 - protein, 10 aa, Homo Sapiens
ITSTLQNITS

SEQ ID NO: 7414 - protein, 10 aa, Homo Sapiens
HTWISIPFCF

SEQ ID NO: 7415 - protein, 10 aa, Homo Sapiens
TALLGNSLIL

SEQ ID NO: 7416 - protein, 10 aa, Homo Sapiens
PSLHEPMYYF

SEQ ID NO: 7417 - protein, 10 aa, Homo Sapiens
TSIIFLLTGV

SEQ ID NO: 7418 - protein, 10 aa, Homo Sapiens
IFLLTGVPGL

SEQ ID NO: 7419 - protein, 10 aa, Homo Sapiens
LTGVPGLEAF

SEQ ID NO: 7420 - protein, 10 aa, Homo Sapiens
VPGLEAFHTW

SEQ ID NO: 7421 - protein, 10 aa, Homo Sapiens
PGLEAFHTWI

SEQ ID NO: 7422 - protein, 10 aa, Homo Sapiens
VTALLGNSLI

SEQ ID NO: 7423 - protein, 10 aa, Homo Sapiens
ITQPSLHEPM

SEQ ID NO: 7424 - protein, 10 aa, Homo Sapiens
HEPMYYFLSM

SEQ ID NO: 7425 - protein, 10 aa, Homo Sapiens
PMYYFLSMLS

SEQ ID NO: 7426 - protein, 10 aa, Homo Sapiens
TSTLQNITST

SEQ ID NO: 7427 - protein, 10 aa, Homo Sapiens
LQNITSTSII

SEQ ID NO: 7428 - protein, 10 aa, Homo Sapiens
FCFLSVTALL

SEQ ID NO: 7429 - protein, 10 aa, Homo Sapiens
EPMYYFLSML

SEQ ID NO: 7430 - protein, 10 aa, Homo Sapiens
TSTSIIFLLT

SEQ ID NO: 7431 - protein, 10 aa, Homo Sapiens
LEAFHTWISI

SEQ ID NO: 7432 - protein, 10 aa, Homo Sapiens
EAFHTWISIP

SEQ ID NO: 7433 - protein, 10 aa, Homo Sapiens
TWISIPFCFL

SEQ ID NO: 7434 - protein, 10 aa, Homo Sapiens
LFATITQPSL

SEQ ID NO: 7435 - protein, 10 aa, Homo Sapiens
LHEPMYYFLS

SEQ ID NO: 7436 - protein, 10 aa, Homo Sapiens
ITSTSIIFLL

SEQ ID NO: 7437 - protein, 10 aa, Homo Sapiens
PFCFLSVTAL

SEQ ID NO: 7438 - protein, 10 aa, Homo Sapiens
LSVTALLGNS

SEQ ID NO: 7439 - protein, 10 aa, Homo Sapiens
LGNSLILFAT

SEQ ID NO: 7440 - protein, 10 aa, Homo Sapiens
EPMYYFLSML

SEQ ID NO: 7441 - protein, 10 aa, Homo Sapiens
IPFCFLSVTA

SEQ ID NO: 7442 - protein, 10 aa, Homo Sapiens
ITSTSIIFLL

SEQ ID NO: 7443 - protein, 10 aa, Homo Sapiens
IFLLTGVPGL

SEQ ID NO: 7444 - protein, 10 aa, Homo Sapiens
PFCFLSVTAL

SEQ ID NO: 7445 - protein, 10 aa, Homo Sapiens
VPGLEAFHTW

SEQ ID NO: 7446 - protein, 10 aa, Homo Sapiens
TWISIPFCFL

SEQ ID NO: 7447 - protein, 10 aa, Homo Sapiens
FCFLSVTALL

SEQ ID NO: 7448 - protein, 10 aa, Homo Sapiens
TALLGNSLIL

SEQ ID NO: 7449 - protein, 10 aa, Homo Sapiens
LFATITQPSL

SEQ ID NO: 7450 - protein, 10 aa, Homo Sapiens
QPSLHEPMYY

SEQ ID NO: 7451 - protein, 10 aa, Homo Sapiens
NITSTSIIFL

SEQ ID NO: 7452 - protein, 10 aa, Homo Sapiens
ISIPFCFLSV

SEQ ID NO: 7453 - protein, 10 aa, Homo Sapiens
SVTALLGNSL

SEQ ID NO: 7454 - protein, 10 aa, Homo Sapiens
SLHEPMYYFL

SEQ ID NO: 7455 - protein, 10 aa, Homo Sapiens
LLTGVPGLEA

SEQ ID NO: 7456 - protein, 10 aa, Homo Sapiens
ALLGNSLILF

SEQ ID NO: 7457 - protein, 10 aa, Homo Sapiens
LLGNSLILFA

SEQ ID NO: 7458 - protein, 10 aa, Homo Sapiens
GNSLILFATI

SEQ ID NO: 7459 - protein, 10 aa, Homo Sapiens
TSTSIIFLLT

SEQ ID NO: 7460 - protein, 10 aa, Homo Sapiens
AFHTWISIPF

SEQ ID NO: 7461 - protein, 10 aa, Homo Sapiens
ITQPSLHEPM

SEQ ID NO: 7462 - protein, 10 aa, Homo Sapiens
HEPMYYFLSM

SEQ ID NO: 7463 - protein, 10 aa, Homo Sapiens
LTGVPGLEAF

SEQ ID NO: 7464 - protein, 10 aa, Homo Sapiens
GVPGLEAFHT

SEQ ID NO: 7465 - protein, 10 aa, Homo Sapiens
TSTLQNITST

SEQ ID NO: 7466 - protein, 10 aa, Homo Sapiens
TLQNITSTSI

SEQ ID NO: 7467 - protein, 10 aa, Homo Sapiens
LQNITSTSII

SEQ ID NO: 7468 - protein, 10 aa, Homo Sapiens
TSIIFLLTGV

SEQ ID NO: 7469 - protein, 10 aa, Homo Sapiens
PGLEAFHTWI

SEQ ID NO: 7470 - protein, 10 aa, Homo Sapiens
LEAFHTWISI

SEQ ID NO: 7471 - protein, 10 aa, Homo Sapiens
SIPFCFLSVT

SEQ ID NO: 7472 - protein, 10 aa, Homo Sapiens
VTALLGNSLI

SEQ ID NO: 7473 - protein, 10 aa, Homo Sapiens
LGNSLILFAT

SEQ ID NO: 7474 - protein, 10 aa, Homo Sapiens
NSLILFATIT

SEQ ID NO: 7475 - protein, 10 aa, Homo Sapiens
FITSTLQNIT

SEQ ID NO: 7476 - protein, 10 aa, Homo Sapiens
QNITSTSIIF

SEQ ID NO: 7477 - protein, 10 aa, Homo Sapiens
HTWISIPFCF

SEQ ID NO: 7478 - protein, 10 aa, Homo Sapiens
PSLHEPMYYF

SEQ ID NO: 7479 - protein, 10 aa, Homo Sapiens
STSIIFLLTG

SEQ ID NO: 7480 - protein, 10 aa, Homo Sapiens
IIFLLTGVPG

SEQ ID NO: 7481 - protein, 10 aa, Homo Sapiens
FLSVTALLGN

SEQ ID NO: 7482 - protein, 10 aa, Homo Sapiens
ILFATITQPS

SEQ ID NO: 7483 - protein, 10 aa, Homo Sapiens
ATITQPSLHE

SEQ ID NO: 7484 - protein, 10 aa, Homo Sapiens
ITSTLQNITS

SEQ ID NO: 7485 - protein, 10 aa, Homo Sapiens
TGVPGLEAFH

SEQ ID NO: 7486 - protein, 10 aa, Homo Sapiens
SIIFLLTGVP

SEQ ID NO: 7487 - protein, 10 aa, Homo Sapiens
GLEAFHTWIS

SEQ ID NO: 7488 - protein, 10 aa, Homo Sapiens
FHTWISIPFC

SEQ ID NO: 7489 - protein, 10 aa, Homo Sapiens
WISIPFCFLS

SEQ ID NO: 7490 - protein, 10 aa, Homo Sapiens
CFLSVTALLG

SEQ ID NO: 7491 - protein, 10 aa, Homo Sapiens
STLQNITSTS

SEQ ID NO: 7492 - protein, 10 aa, Homo Sapiens
EAFHTWISIP

SEQ ID NO: 7493 - protein, 10 aa, Homo Sapiens
SLILFATITQ

SEQ ID NO: 7494 - protein, 10 aa, Homo Sapiens
LILFATITQP

SEQ ID NO: 7495 - protein, 10 aa, Homo Sapiens
TQPSLHEPMY

SEQ ID NO: 7496 - protein, 10 aa, Homo Sapiens
LHEPMYYFLS

SEQ ID NO: 7497 - protein, 10 aa, Homo Sapiens
LEAFHTWISI

SEQ ID NO: 7498 - protein, 10 aa, Homo Sapiens
ALLGNSLILF

SEQ ID NO: 7499 - protein, 10 aa, Homo Sapiens
ITSTSIIFLL

SEQ ID NO: 7500 - protein, 10 aa, Homo Sapiens
QNITSTSIIF

SEQ ID NO: 7501 - protein, 10 aa, Homo Sapiens
NITSTSIIFL

SEQ ID NO: 7502 - protein, 10 aa, Homo Sapiens
AFHTWISIPF

SEQ ID NO: 7503 - protein, 10 aa, Homo Sapiens
FCFLSVTALL

SEQ ID NO: 7504 - protein, 10 aa, Homo Sapiens
VPGLEAFHTW

SEQ ID NO: 7505 - protein, 10 aa, Homo Sapiens
TWISIPFCFL

SEQ ID NO: 7506 - protein, 10 aa, Homo Sapiens
EPMYYFLSML

SEQ ID NO: 7507 - protein, 10 aa, Homo Sapiens
IFLLTGVPGL

SEQ ID NO: 7508 - protein, 10 aa, Homo Sapiens
LTGVPGLEAF

SEQ ID NO: 7509 - protein, 10 aa, Homo Sapiens
PFCFLSVTAL

SEQ ID NO: 7510 - protein, 10 aa, Homo Sapiens
TALLGNSLIL

SEQ ID NO: 7511 - protein, 10 aa, Homo Sapiens
QPSLHEPMYY

SEQ ID NO: 7512 - protein, 10 aa, Homo Sapiens
HEPMYYFLSM

SEQ ID NO: 7513 - protein, 10 aa, Homo Sapiens
SVTALLGNSL

SEQ ID NO: 7514 - protein, 10 aa, Homo Sapiens
GNSLILFATI

SEQ ID NO: 7515 - protein, 10 aa, Homo Sapiens
HTWISIPFCF

SEQ ID NO: 7516 - protein, 10 aa, Homo Sapiens
LFATITQPSL

SEQ ID NO: 7517 - protein, 10 aa, Homo Sapiens
TQPSLHEPMY

SEQ ID NO: 7518 - protein, 10 aa, Homo Sapiens
PSLHEPMYYF

SEQ ID NO: 7519 - protein, 10 aa, Homo Sapiens
SLHEPMYYFL

SEQ ID NO: 7520 - protein, 10 aa, Homo Sapiens
VTALLGNSLI

SEQ ID NO: 7521 - protein, 10 aa, Homo Sapiens
TLQNITSTSI

SEQ ID NO: 7522 - protein, 10 aa, Homo Sapiens
LQNITSTSII

SEQ ID NO: 7523 - protein, 10 aa, Homo Sapiens
PGLEAFHTWI

SEQ ID NO: 7524 - protein, 10 aa, Homo Sapiens
ISIPFCFLSV

SEQ ID NO: 7525 - protein, 10 aa, Homo Sapiens
SLILFATITQ

SEQ ID NO: 7526 - protein, 10 aa, Homo Sapiens
ATITQPSLHE

SEQ ID NO: 7527 - protein, 10 aa, Homo Sapiens
EAFHTWISIP

SEQ ID NO: 7528 - protein, 10 aa, Homo Sapiens
SIIFLLTGVP

SEQ ID NO: 7529 - protein, 10 aa, Homo Sapiens
STSIIFLLTG

SEQ ID NO: 7530 - protein, 10 aa, Homo Sapiens
LLGNSLILFA

SEQ ID NO: 7531 - protein, 10 aa, Homo Sapiens
LILFATITQP

SEQ ID NO: 7532 - protein, 10 aa, Homo Sapiens
ITSTLQNITS

SEQ ID NO: 7533 - protein, 10 aa, Homo Sapiens
TSTLQNITST

SEQ ID NO: 7534 - protein, 10 aa, Homo Sapiens
STLQNITSTS

SEQ ID NO: 7535 - protein, 10 aa, Homo Sapiens
TSIIFLLTGV

SEQ ID NO: 7536 - protein, 10 aa, Homo Sapiens
IIFLLTGVPG

SEQ ID NO: 7537 - protein, 10 aa, Homo Sapiens
FLLTGVPGLE

SEQ ID NO: 7538 - protein, 10 aa, Homo Sapiens
SIPFCFLSVT

SEQ ID NO: 7539 - protein, 10 aa, Homo Sapiens
IPFCFLSVTA

SEQ ID NO: 7540 - protein, 10 aa, Homo Sapiens
CFLSVTALLG

SEQ ID NO: 7541 - protein, 10 aa, Homo Sapiens
LHEPMYYFLS

SEQ ID NO: 7542 - protein, 10 aa, Homo Sapiens
TSTSIIFLLT

SEQ ID NO: 7543 - protein, 10 aa, Homo Sapiens
LLTSPLMNPV

SEQ ID NO: 7544 - protein, 10 aa, Homo Sapiens
YLLTSPLMNP

SEQ ID NO: 7545 - protein, 10 aa, Homo Sapiens
MIANTYLLTS

SEQ ID NO: 7546 - protein, 10 aa, Homo Sapiens
LTSPLMNPVI

SEQ ID NO: 7547 - protein, 10 aa, Homo Sapiens
TMIANTYLLT

SEQ ID NO: 7548 - protein, 10 aa, Homo Sapiens
IANTYLLTSP

SEQ ID NO: 7549 - protein, 10 aa, Homo Sapiens
ANTYLLTSPL

SEQ ID NO: 7550 - protein, 10 aa, Homo Sapiens
NTYLLTSPLM

SEQ ID NO: 7551 - protein, 10 aa, Homo Sapiens
TYLLTSPLMN

SEQ ID NO: 7552 - protein, 10 aa, Homo Sapiens
TSPLMNPVIY

SEQ ID NO: 7553 - protein, 10 aa, Homo Sapiens
MIANTYLLTS

SEQ ID NO: 7554 - protein, 10 aa, Homo Sapiens
IANTYLLTSP

SEQ ID NO: 7555 - protein, 10 aa, Homo Sapiens
ANTYLLTSPL

SEQ ID NO: 7556 - protein, 10 aa, Homo Sapiens
TSPLMNPVIY

SEQ ID NO: 7557 - protein, 10 aa, Homo Sapiens
LTSPLMNPVI

SEQ ID NO: 7558 - protein, 10 aa, Homo Sapiens
TMIANTYLLT

SEQ ID NO: 7559 - protein, 10 aa, Homo Sapiens
NTYLLTSPLM

SEQ ID NO: 7560 - protein, 10 aa, Homo Sapiens
TYLLTSPLMN

SEQ ID NO: 7561 - protein, 10 aa, Homo Sapiens
MIANTYLLTS

SEQ ID NO: 7562 - protein, 10 aa, Homo Sapiens
YLLTSPLMNP

SEQ ID NO: 7563 - protein, 10 aa, Homo Sapiens
ANTYLLTSPL

SEQ ID NO: 7564 - protein, 10 aa, Homo Sapiens
LLTSPLMNPV

SEQ ID NO: 7565 - protein, 10 aa, Homo Sapiens
NTYLLTSPLM

SEQ ID NO: 7566 - protein, 10 aa, Homo Sapiens
MIANTYLLTS

SEQ ID NO: 7567 - protein, 10 aa, Homo Sapiens
YLLTSPLMNP

SEQ ID NO: 7568 - protein, 10 aa, Homo Sapiens
LLTSPLMNPV

SEQ ID NO: 7569 - protein, 10 aa, Homo Sapiens
LTSPLMNPVI

SEQ ID NO: 7570 - protein, 10 aa, Homo Sapiens
TSPLMNPVIY

SEQ ID NO: 7571 - protein, 10 aa, Homo Sapiens
ANTYLLTSPL

SEQ ID NO: 7572 - protein, 10 aa, Homo Sapiens
TMIANTYLLT

SEQ ID NO: 7573 - protein, 10 aa, Homo Sapiens
IANTYLLTSP

SEQ ID NO: 7574 - protein, 10 aa, Homo Sapiens
TYLLTSPLMN

SEQ ID NO: 7575 - protein, 10 aa, Homo Sapiens
MIANTYLLTS

SEQ ID NO: 7576 - protein, 10 aa, Homo Sapiens
YLLTSPLMNP

SEQ ID NO: 7577 - protein, 10 aa, Homo Sapiens
TSPLMNPVIY

SEQ ID NO: 7578 - protein, 10 aa, Homo Sapiens
LLTSPLMNPV

SEQ ID NO: 7579 - protein, 10 aa, Homo Sapiens
TMIANTYLLT

SEQ ID NO: 7580 - protein, 10 aa, Homo Sapiens
TYLLTSPLMN

SEQ ID NO: 7581 - protein, 10 aa, Homo Sapiens
LTSPLMNPVI

SEQ ID NO: 7582 - protein, 10 aa, Homo Sapiens
ANTYLLTSPL

SEQ ID NO: 7583 - protein, 10 aa, Homo Sapiens
IANTYLLTSP

SEQ ID NO: 7584 - protein, 10 aa, Homo Sapiens
NTYLLTSPLM

SEQ ID NO: 7585 - protein, 10 aa, Homo Sapiens
ANTYLLTSPL

SEQ ID NO: 7586 - protein, 10 aa, Homo Sapiens
LTSPLMNPVI

SEQ ID NO: 7587 - protein, 10 aa, Homo Sapiens
TMIANTYLLT

SEQ ID NO: 7588 - protein, 15 aa, Homo Sapiens
YYFLSMLSATDLGLS

SEQ ID NO: 7589 - protein, 15 aa, Homo Sapiens
VDLLLILLSYVLIIR

SEQ ID NO: 7590 - protein, 15 aa, Homo Sapiens
IKFFTVMESSVLLAM

SEQ ID NO: 7591 - protein, 15 aa, Homo Sapiens
AIYYIPLISLSIVHR

SEQ ID NO: 7592 - protein, 15 aa, Homo Sapiens
VHRFGKQAPAYVHTM

SEQ ID NO: 7593 - protein, 15 aa, Homo Sapiens
IRGLLMLTPMVALLI

SEQ ID NO: 7594 - protein, 15 aa, Homo Sapiens
LLMLTPMVALLIRLS

SEQ ID NO: 7595 - protein, 15 aa, Homo Sapiens
LSYVLIIRTVLSVAS

SEQ ID NO: 7596 - protein, 15 aa, Homo Sapiens
GLSISTLVTMLSIFW

SEQ ID NO: 7597 - protein, 15 aa, Homo Sapiens
VLIIRTVLSVASPEE

SEQ ID NO: 7598 - protein, 15 aa, Homo Sapiens
STCVSHIVAFAIYYI

SEQ ID NO: 7599 - protein, 15 aa, Homo Sapiens
NPVIYSVKTKQIRRA

SEQ ID NO: 7600 - protein, 15 aa, Homo Sapiens
LLSYVLIIRTVLSVA

SEQ ID NO: 7601 - protein, 15 aa, Homo Sapiens
STLVTMLSIFWFNVR

SEQ ID NO: 7602 - protein, 15 aa, Homo Sapiens
ASVIRGLLMLTPMVA

SEQ ID NO: 7603 - protein, 15 aa, Homo Sapiens
LTPMVALLIRLSYCH

SEQ ID NO: 7604 - protein, 15 aa, Homo Sapiens
SLSIVHRFGKQAPAY

SEQ ID NO: 7605 - protein, 15 aa, Homo Sapiens
EISFNACLSHMFFIK

SEQ ID NO: 7606 - protein, 15 aa, Homo Sapiens
DTRINSAVGLTAMFS

SEQ ID NO: 7607 - protein, 15 aa, Homo Sapiens
INSAVGLTAMFSTVG

SEQ ID NO: 7608 - protein, 15 aa, Homo Sapiens
TAMFSTVGVDLLLIL

SEQ ID NO: 7609 - protein, 15 aa, Homo Sapiens
TVGVDLLLILLSYVL

SEQ ID NO: 7610 - protein, 15 aa, Homo Sapiens
DLLLILLSYVLIIRT

SEQ ID NO: 7611 - protein, 15 aa, Homo Sapiens
ATDLGLSISTLVTML

SEQ ID NO: 7612 - protein, 15 aa, Homo Sapiens
SIFWFNVREISFNAC

SEQ ID NO: 7613 - protein, 15 aa, Homo Sapiens
FIKFFTVMESSVLLA

SEQ ID NO: 7614 - protein, 15 aa, Homo Sapiens
VMESSVLLAMAFDRF

SEQ ID NO: 7615 - protein, 15 aa, Homo Sapiens
RYAMILTDSRIAQIG

SEQ ID NO: 7616 - protein, 15 aa, Homo Sapiens
VALLIRLSYCHSQVL

SEQ ID NO: 7617 - protein, 15 aa, Homo Sapiens
LTAMFSTVGVDLLLI

SEQ ID NO: 7618 - protein, 15 aa, Homo Sapiens
KETFSTCVSHIVAFA

SEQ ID NO: 7619 - protein, 15 aa, Homo Sapiens
YLLISPLMNPVIYSV

SEQ ID NO: 7620 - protein, 15 aa, Homo Sapiens
NACLSHMFFIKFFTV

SEQ ID NO: 7621 - protein, 15 aa, Homo Sapiens
LSHMFFIKFFTVMES

SEQ ID NO: 7622 - protein, 15 aa, Homo Sapiens
PLRYAMILTDSRIAQ

SEQ ID NO: 7623 - protein, 15 aa, Homo Sapiens
DSRIAQIGVASVIRG

SEQ ID NO: 7624 - protein, 15 aa, Homo Sapiens
CTDTRINSAVGLTAM

SEQ ID NO: 7625 - protein, 15 aa, Homo Sapiens
GVDLLLILLSYVLII

SEQ ID NO: 7626 - protein, 15 aa, Homo Sapiens
IYYIPLISLSIVHRF

SEQ ID NO: 7627 - protein, 15 aa, Homo Sapiens
IANTYLLISPLMNPV

SEQ ID NO: 7628 - protein, 15 aa, Homo Sapiens
ANTYLLISPLMNPVI

SEQ ID NO: 7629 - protein, 15 aa, Homo Sapiens
MYYFLSMLSATDLGL

SEQ ID NO: 7630 - protein, 15 aa, Homo Sapiens
LVTMLSIFWFNVREI

SEQ ID NO: 7631 - protein, 15 aa, Homo Sapiens
SHMFFIKFFTVMESS

SEQ ID NO: 7632 - protein, 15 aa, Homo Sapiens
SSVLLAMAFDRFVAV

SEQ ID NO: 7633 - protein, 15 aa, Homo Sapiens
TDSRIAQIGVASVIR

SEQ ID NO: 7634 - protein, 15 aa, Homo Sapiens
QIGVASVIRGLLMLT

SEQ ID NO: 7635 - protein, 15 aa, Homo Sapiens
IGVASVIRGLLMLTP

SEQ ID NO: 7636 - protein, 15 aa, Homo Sapiens
LIRLSYCHSQVLHHS

SEQ ID NO: 7637 - protein, 15 aa, Homo Sapiens
AVGLTAMFSTVGVDL

SEQ ID NO: 7638 - protein, 15 aa, Homo Sapiens
AFAIYYIPLISLSIV

SEQ ID NO: 7639 - protein, 15 aa, Homo Sapiens
PAYVHTMIANTYLLI

SEQ ID NO: 7640 - protein, 15 aa, Homo Sapiens
ISTLVTMLSIFWFNV

SEQ ID NO: 7641 - protein, 15 aa, Homo Sapiens
VIRGLLMLTPMVALL

SEQ ID NO: 7642 - protein, 15 aa, Homo Sapiens
IVAFAIYYIPLISLS

SEQ ID NO: 7643 - protein, 15 aa, Homo Sapiens
FAIYYIPLISLSIVH

SEQ ID NO: 7644 - protein, 15 aa, Homo Sapiens
IRTVLSVASPEERKE

SEQ ID NO: 7645 - protein, 15 aa, Homo Sapiens
KQAPAYVHTMIANTY

SEQ ID NO: 7646 - protein, 15 aa, Homo Sapiens
DLGLSISTLVTMLSI

SEQ ID NO: 7647 - protein, 15 aa, Homo Sapiens
LSIFWFNVREISFNA

SEQ ID NO: 7648 - protein, 15 aa, Homo Sapiens
LRYAMILTDSRIAQI

SEQ ID NO: 7649 - protein, 15 aa, Homo Sapiens
SRIAQIGVASVIRGL

SEQ ID NO: 7650 - protein, 15 aa, Homo Sapiens
SYCYHPDVMKLSCTD

SEQ ID NO: 7651 - protein, 15 aa, Homo Sapiens
HPDVMKLSCTDTRIN

SEQ ID NO: 7652 - protein, 15 aa, Homo Sapiens
SYVLIIRTVLSVASP

SEQ ID NO: 7653 - protein, 15 aa, Homo Sapiens
LISLSIVHRFGKQAP

SEQ ID NO: 7654 - protein, 15 aa, Homo Sapiens
NTYLLISPLMNPVIY

SEQ ID NO: 7655 - protein, 15 aa, Homo Sapiens
TKQIRRAVIKILHSK

SEQ ID NO: 7656 - protein, 15 aa, Homo Sapiens
FLSMLSATDLGLSIS

SEQ ID NO: 7657 - protein, 15 aa, Homo Sapiens
MLSATDLGLSISTLV

SEQ ID NO: 7658 - protein, 15 aa, Homo Sapiens
HMFFIKFFTVMESSV

SEQ ID NO: 7659 - protein, 15 aa, Homo Sapiens
MFFIKFFTVMESSVL

SEQ ID NO: 7660 - protein, 15 aa, Homo Sapiens
SVLLAMAFDRFVAVS

SEQ ID NO: 7661 - protein, 15 aa, Homo Sapiens
AMAFDRFVAVSNPLR

SEQ ID NO: 7662 - protein, 15 aa, Homo Sapiens
SVIRGLLMLTPMVAL

SEQ ID NO: 7663 - protein, 15 aa, Homo Sapiens
IYSVKTKQIRRAVIK

SEQ ID NO: 7664 - protein, 15 aa, Homo Sapiens
YSVKTKQIRRAVIKI

SEQ ID NO: 7665 - protein, 15 aa, Homo Sapiens
MLSIFWFNVREISFN

SEQ ID NO: 7666 - protein, 15 aa, Homo Sapiens
ESSVLLAMAFDRFVA

SEQ ID NO: 7667 - protein, 15 aa, Homo Sapiens
LLAMAFDRFVAVSNP

SEQ ID NO: 7668 - protein, 15 aa, Homo Sapiens
MAFDRFVAVSNPLRY

SEQ ID NO: 7669 - protein, 15 aa, Homo Sapiens
FDRFVAVSNPLRYAM

SEQ ID NO: 7670 - protein, 15 aa, Homo Sapiens
VAVSNPLRYAMILTD

SEQ ID NO: 7671 - protein, 15 aa, Homo Sapiens
AVSNPLRYAMILTDS

SEQ ID NO: 7672 - protein, 15 aa, Homo Sapiens
AMILTDSRIAQIGVA

SEQ ID NO: 7673 - protein, 15 aa, Homo Sapiens
RGLLMLTPMVALLIR

SEQ ID NO: 7674 - protein, 15 aa, Homo Sapiens
TPMVALLIRLSYCHS

SEQ ID NO: 7675 - protein, 15 aa, Homo Sapiens
MVALLIRLSYCHSQV

SEQ ID NO: 7676 - protein, 15 aa, Homo Sapiens
VGLTAMFSTVGVDLL

SEQ ID NO: 7677 - protein, 15 aa, Homo Sapiens
STVGVDLLLILLSYV

SEQ ID NO: 7678 - protein, 15 aa, Homo Sapiens
LLLILLSYVLIIRTV

SEQ ID NO: 7679 - protein, 15 aa, Homo Sapiens
ILLSYVLIIRTVLSV

SEQ ID NO: 7680 - protein, 15 aa, Homo Sapiens
LIIRTVLSVASPEER

SEQ ID NO: 7681 - protein, 15 aa, Homo Sapiens
VSHIVAFAIYYIPLI

SEQ ID NO: 7682 - protein, 15 aa, Homo Sapiens
SHIVAFAIYYIPLIS

SEQ ID NO: 7683 - protein, 15 aa, Homo Sapiens
IPLISLSIVHRFGKQ

SEQ ID NO: 7684 - protein, 15 aa, Homo Sapiens
LSIVHRFGKQAPAYV

SEQ ID NO: 7685 - protein, 15 aa, Homo Sapiens
AYVHTMIANTYLLIS

SEQ ID NO: 7686 - protein, 15 aa, Homo Sapiens
YVHTMIANTYLLISP

SEQ ID NO: 7687 - protein, 15 aa, Homo Sapiens
MIANTYLLISPLMNP

SEQ ID NO: 7688 - protein, 15 aa, Homo Sapiens
LSMLSATDLGLSIST

SEQ ID NO: 7689 - protein, 15 aa, Homo Sapiens
SMLSATDLGLSISTL

SEQ ID NO: 7690 - protein, 15 aa, Homo Sapiens
SATDLGLSISTLVTM

SEQ ID NO: 7691 - protein, 15 aa, Homo Sapiens
LSISTLVTMLSIFWF

SEQ ID NO: 7692 - protein, 15 aa, Homo Sapiens
WFNVREISFNACLSH

SEQ ID NO: 7693 - protein, 15 aa, Homo Sapiens
NVREISFNACLSHMF

SEQ ID NO: 7694 - protein, 15 aa, Homo Sapiens
ISFNACLSHMFFIKF

SEQ ID NO: 7695 - protein, 15 aa, Homo Sapiens
KFFTVMESSVLLAMA

SEQ ID NO: 7696 - protein, 15 aa, Homo Sapiens
FFTVMESSVLLAMAF

SEQ ID NO: 7697 - protein, 15 aa, Homo Sapiens
FTVMESSVLLAMAFD

SEQ ID NO: 7698 - protein, 15 aa, Homo Sapiens
FVAVSNPLRYAMILT

SEQ ID NO: 7699 - protein, 15 aa, Homo Sapiens
ILTDSRIAQIGVASV

SEQ ID NO: 7700 - protein, 15 aa, Homo Sapiens
GLLMLTPMVALLIRL

SEQ ID NO: 7701 - protein, 15 aa, Homo Sapiens
SQVLHHSYCYHPDVM

SEQ ID NO: 7702 - protein, 15 aa, Homo Sapiens
PDVMKLSCTDTRINS

SEQ ID NO: 7703 - protein, 15 aa, Homo Sapiens
TRINSAVGLTAMFST

SEQ ID NO: 7704 - protein, 15 aa, Homo Sapiens
FSTVGVDLLLILLSY

SEQ ID NO: 7705 - protein, 15 aa, Homo Sapiens
YVLIIRTVLSVASPE

SEQ ID NO: 7706 - protein, 15 aa, Homo Sapiens
PEERKETFSTCVSHI

SEQ ID NO: 7707 - protein, 15 aa, Homo Sapiens
YIPLISLSIVHRFGK

SEQ ID NO: 7708 - protein, 15 aa, Homo Sapiens
VHTMIANTYLLISPL

SEQ ID NO: 7709 - protein, 15 aa, Homo Sapiens
HTMIANTYLLISPLM

SEQ ID NO: 7710 - protein, 15 aa, Homo Sapiens
TYLLISPLMNPVIYS

SEQ ID NO: 7711 - protein, 15 aa, Homo Sapiens
ISPLMNPVIYSVKTK

SEQ ID NO: 7712 - protein, 15 aa, Homo Sapiens
FWFNVREISFNACLS

SEQ ID NO: 7713 - protein, 15 aa, Homo Sapiens
NPLRYAMILTDSRIA

SEQ ID NO: 7714 - protein, 15 aa, Homo Sapiens
VMKLSCTDTRINSAV

SEQ ID NO: 7715 - protein, 15 aa, Homo Sapiens
MFSTVGVDLLLILLS

SEQ ID NO: 7716 - protein, 15 aa, Homo Sapiens
ETFSTCVSHIVAFAI

SEQ ID NO: 7717 - protein, 15 aa, Homo Sapiens
SPLMNPVIYSVKTKQ

SEQ ID NO: 7718 - protein, 15 aa, Homo Sapiens
SVKTKQIRRAVIKIL

SEQ ID NO: 7719 - protein, 15 aa, Homo Sapiens
TVMESSVLLAMAFDR

SEQ ID NO: 7720 - protein, 15 aa, Homo Sapiens
AFDRFVAVSNPLRYA

SEQ ID NO: 7721 - protein, 15 aa, Homo Sapiens
DRFVAVSNPLRYAMI

SEQ ID NO: 7722 - protein, 15 aa, Homo Sapiens
LSYCHSQVLHHSYCY

SEQ ID NO: 7723 - protein, 15 aa, Homo Sapiens
LHHSYCYHPDVMKLS

SEQ ID NO: 7724 - protein, 15 aa, Homo Sapiens
RINSAVGLTAMFSTV

SEQ ID NO: 7725 - protein, 15 aa, Homo Sapiens
LILLSYVLIIRTVLS

SEQ ID NO: 7726 - protein, 15 aa, Homo Sapiens
RTVLSVASPEERKET

SEQ ID NO: 7727 - protein, 15 aa, Homo Sapiens
EERKETFSTCVSHIV

SEQ ID NO: 7728 - protein, 15 aa, Homo Sapiens
HIVAFAIYYIPLISL

SEQ ID NO: 7729 - protein, 15 aa, Homo Sapiens
VAFAIYYIPLISLSI

SEQ ID NO: 7730 - protein, 15 aa, Homo Sapiens
QIRRAVIKILHSKET

SEQ ID NO: 7731 - protein, 15 aa, Homo Sapiens
LTDSRIAQIGVASVI

SEQ ID NO: 7732 - protein, 15 aa, Homo Sapiens
GVASVIRGLLMLTPM

SEQ ID NO: 7733 - protein, 15 aa, Homo Sapiens
SCTDTRINSAVGLTA

SEQ ID NO: 7734 - protein, 15 aa, Homo Sapiens
LLISPLMNPVIYSVK

SEQ ID NO: 7735 - protein, 15 aa, Homo Sapiens
PLMNPVIYSVKTKQI

SEQ ID NO: 7736 - protein, 15 aa, Homo Sapiens
TDLGLSISTLVTMLS

SEQ ID NO: 7737 - protein, 15 aa, Homo Sapiens
IFWFNVREISFNACL

SEQ ID NO: 7738 - protein, 15 aa, Homo Sapiens
RIAQIGVASVIRGLL

SEQ ID NO: 7739 - protein, 15 aa, Homo Sapiens
AQIGVASVIRGLLML

SEQ ID NO: 7740 - protein, 15 aa, Homo Sapiens
VTMLSIFWFNVREIS

SEQ ID NO: 7741 - protein, 15 aa, Homo Sapiens
FNVREISFNACLSHM

SEQ ID NO: 7742 - protein, 15 aa, Homo Sapiens
ALLIRLSYCHSQVLH

SEQ ID NO: 7743 - protein, 15 aa, Homo Sapiens
VLSVASPEERKETFS

SEQ ID NO: 7744 - protein, 15 aa, Homo Sapiens
SIVHRFGKQAPAYVH

SEQ ID NO: 7745 - protein, 15 aa, Homo Sapiens
APAYVHTMIANTYLL

SEQ ID NO: 7746 - protein, 15 aa, Homo Sapiens
VKTKQIRRAVIKILH

SEQ ID NO: 7747 - protein, 15 aa, Homo Sapiens
ACLSHMFFIKFFTVM

SEQ ID NO: 7748 - protein, 15 aa, Homo Sapiens
MESSVLLAMAFDRFV

SEQ ID NO: 7749 - protein, 15 aa, Homo Sapiens
RFVAVSNPLRYAMIL

SEQ ID NO: 7750 - protein, 15 aa, Homo Sapiens
SNPLRYAMILTDSRI

SEQ ID NO: 7751 - protein, 15 aa, Homo Sapiens
RLSYCHSQVLHHSYC

SEQ ID NO: 7752 - protein, 15 aa, Homo Sapiens
HHSYCYHPDVMKLSC

SEQ ID NO: 7753 - protein, 15 aa, Homo Sapiens
IIRTVLSVASPEERK

SEQ ID NO: 7754 - protein, 15 aa, Homo Sapiens
MNPVIYSVKTKQIRR

SEQ ID NO: 7755 - protein, 15 aa, Homo Sapiens
PVIYSVKTKQIRRAV

SEQ ID NO: 7756 - protein, 15 aa, Homo Sapiens
LGLSISTLVTMLSIF

SEQ ID NO: 7757 - protein, 15 aa, Homo Sapiens
VREISFNACLSHMFF

SEQ ID NO: 7758 - protein, 15 aa, Homo Sapiens
SFNACLSHMFFIKFF

SEQ ID NO: 7759 - protein, 15 aa, Homo Sapiens
FFIKFFTVMESSVLL

SEQ ID NO: 7760 - protein, 15 aa, Homo Sapiens
HSYCYHPDVMKLSCT

SEQ ID NO: 7761 - protein, 15 aa, Homo Sapiens
DVMKLSCTDTRINSA

SEQ ID NO: 7762 - protein, 15 aa, Homo Sapiens
KLSCTDTRINSAVGL

SEQ ID NO: 7763 - protein, 15 aa, Homo Sapiens
NSAVGLTAMFSTVGV

SEQ ID NO: 7764 - protein, 15 aa, Homo Sapiens
AMFSTVGVDLLLILL

SEQ ID NO: 7765 - protein, 15 aa, Homo Sapiens
VGVDLLLILLSYVLI

SEQ ID NO: 7766 - protein, 15 aa, Homo Sapiens
VASPEERKETFSTCV

SEQ ID NO: 7767 - protein, 15 aa, Homo Sapiens
FSTCVSHIVAFAIYY

SEQ ID NO: 7768 - protein, 15 aa, Homo Sapiens
TCVSHIVAFAIYYIP

SEQ ID NO: 7769 - protein, 15 aa, Homo Sapiens
YYIPLISLSIVHRFG

SEQ ID NO: 7770 - protein, 15 aa, Homo Sapiens
HRFGKQAPAYVHTMI

SEQ ID NO: 7771 - protein, 15 aa, Homo Sapiens
GKQAPAYVHTMIANT

SEQ ID NO: 7772 - protein, 15 aa, Homo Sapiens
TMIANTYLLISPLMN

SEQ ID NO: 7773 - protein, 15 aa, Homo Sapiens
LISPLMNPVIYSVKT

SEQ ID NO: 7774 - protein, 15 aa, Homo Sapiens
KTKQIRRAVIKILHS

SEQ ID NO: 7775 - protein, 15 aa, Homo Sapiens
SISTLVTMLSIFWFN

SEQ ID NO: 7776 - protein, 15 aa, Homo Sapiens
REISFNACLSHMFFI

SEQ ID NO: 7777 - protein, 15 aa, Homo Sapiens
VLLAMAFDRFVAVSN

SEQ ID NO: 7778 - protein, 15 aa, Homo Sapiens
LAMAFDRFVAVSNPL

SEQ ID NO: 7779 - protein, 15 aa, Homo Sapiens
YAMILTDSRIAQIGV

SEQ ID NO: 7780 - protein, 15 aa, Homo Sapiens
MILTDSRIAQIGVAS

SEQ ID NO: 7781 - protein, 15 aa, Homo Sapiens
IAQIGVASVIRGLLM

SEQ ID NO: 7782 - protein, 15 aa, Homo Sapiens
VASVIRGLLMLTPMV

SEQ ID NO: 7783 - protein, 15 aa, Homo Sapiens
MLTPMVALLIRLSYC

SEQ ID NO: 7784 - protein, 15 aa, Homo Sapiens
LLIRLSYCHSQVLHH

SEQ ID NO: 7785 - protein, 15 aa, Homo Sapiens
YCHSQVLHHSYCYHP

SEQ ID NO: 7786 - protein, 15 aa, Homo Sapiens
CHSQVLHHSYCYHPD

SEQ ID NO: 7787 - protein, 15 aa, Homo Sapiens
HSQVLHHSYCYHPDV

SEQ ID NO: 7788 - protein, 15 aa, Homo Sapiens
VLHHSYCYHPDVMKL

SEQ ID NO: 7789 - protein, 15 aa, Homo Sapiens
YHPDVMKLSCTDTRI

SEQ ID NO: 7790 - protein, 15 aa, Homo Sapiens
MKLSCTDTRINSAVG

SEQ ID NO: 7791 - protein, 15 aa, Homo Sapiens
LSCTDTRINSAVGLT

SEQ ID NO: 7792 - protein, 15 aa, Homo Sapiens
SAVGLTAMFSTVGVD

SEQ ID NO: 7793 - protein, 15 aa, Homo Sapiens
LLILLSYVLIIRTVL

SEQ ID NO: 7794 - protein, 15 aa, Homo Sapiens
SVASPEERKETFSTC

SEQ ID NO: 7795 - protein, 15 aa, Homo Sapiens
RKETFSTCVSHIVAF

SEQ ID NO: 7796 - protein, 15 aa, Homo Sapiens
TFSTCVSHIVAFAIY

SEQ ID NO: 7797 - protein, 15 aa, Homo Sapiens
CVSHIVAFAIYYIPL

SEQ ID NO: 7798 - protein, 15 aa, Homo Sapiens
IVHRFGKQAPAYVHT

SEQ ID NO: 7799 - protein, 15 aa, Homo Sapiens
FGKQAPAYVHTMIAN

SEQ ID NO: 7800 - protein, 15 aa, Homo Sapiens
KQIRRAVIKILHSKE

SEQ ID NO: 7801 - protein, 15 aa, Homo Sapiens
YFLSMLSATDLGLSI

SEQ ID NO: 7802 - protein, 15 aa, Homo Sapiens
LSATDLGLSISTLVT

SEQ ID NO: 7803 - protein, 15 aa, Homo Sapiens
LMLTPMVALLIRLSY

SEQ ID NO: 7804 - protein, 15 aa, Homo Sapiens
PMVALLIRLSYCHSQ

SEQ ID NO: 7805 - protein, 15 aa, Homo Sapiens
ASPEERKETFSTCVS

SEQ ID NO: 7806 - protein, 15 aa, Homo Sapiens
PLISLSIVHRFGKQA

SEQ ID NO: 7807 - protein, 15 aa, Homo Sapiens
SYCHSQVLHHSYCYH

SEQ ID NO: 7808 - protein, 15 aa, Homo Sapiens
YCYHPDVMKLSCTDT

SEQ ID NO: 7809 - protein, 15 aa, Homo Sapiens
CYHPDVMKLSCTDTR

SEQ ID NO: 7810 - protein, 15 aa, Homo Sapiens
LMNPVIYSVKTKQIR

SEQ ID NO: 7811 - protein, 15 aa, Homo Sapiens
SPEERKETFSTCVSH

SEQ ID NO: 7812 - protein, 15 aa, Homo Sapiens
VIYSVKTKQIRRAVI

SEQ ID NO: 7813 - protein, 15 aa, Homo Sapiens
LSVASPEERKETFST

SEQ ID NO: 7814 - protein, 15 aa, Homo Sapiens
ERKETFSTCVSHIVA

SEQ ID NO: 7815 - protein, 15 aa, Homo Sapiens
TLVTMLSIFWFNVRE

SEQ ID NO: 7816 - protein, 15 aa, Homo Sapiens
TMLSIFWFNVREISF

SEQ ID NO: 7817 - protein, 15 aa, Homo Sapiens
CLSHMFFIKFFTVME

SEQ ID NO: 7818 - protein, 15 aa, Homo Sapiens
GLTAMFSTVGVDLLL

SEQ ID NO: 7819 - protein, 15 aa, Homo Sapiens
TVLSVASPEERKETF

SEQ ID NO: 7820 - protein, 15 aa, Homo Sapiens
ISLSIVHRFGKQAPA

SEQ ID NO: 7821 - protein, 15 aa, Homo Sapiens
YAMILTDSRIAQIGV

SEQ ID NO: 7822 - protein, 15 aa, Homo Sapiens
FSTVGVDLLLILLSY

SEQ ID NO: 7823 - protein, 15 aa, Homo Sapiens
QIGVASVIRGLLMLT

SEQ ID NO: 7824 - protein, 15 aa, Homo Sapiens
TPMVALLIRLSYCHS

SEQ ID NO: 7825 - protein, 15 aa, Homo Sapiens
FLSMLSATDLGLSIS

SEQ ID NO: 7826 - protein, 15 aa, Homo Sapiens
LLAMAFDRFVAVSNP

SEQ ID NO: 7827 - protein, 15 aa, Homo Sapiens
RGLLMLTPMVALLIR

SEQ ID NO: 7828 - protein, 15 aa, Homo Sapiens
GLLMLTPMVALLIRL

SEQ ID NO: 7829 - protein, 15 aa, Homo Sapiens
STLVTMLSIFWFNVR

SEQ ID NO: 7830 - protein, 15 aa, Homo Sapiens
VDLLLILLSYVLIIR

SEQ ID NO: 7831 - protein, 15 aa, Homo Sapiens
YYFLSMLSATDLGLS

SEQ ID NO: 7832 - protein, 15 aa, Homo Sapiens
SSVLLAMAFDRFVAV

SEQ ID NO: 7833 - protein, 15 aa, Homo Sapiens
LTAMFSTVGVDLLLI

SEQ ID NO: 7834 - protein, 15 aa, Homo Sapiens
NACLSHMFFIKFFTV

SEQ ID NO: 7835 - protein, 15 aa, Homo Sapiens
DRFVAVSNPLRYAMI

SEQ ID NO: 7836 - protein, 15 aa, Homo Sapiens
LIRLSYCHSQVLHHS

SEQ ID NO: 7837 - protein, 15 aa, Homo Sapiens
VLSVASPEERKETFS

SEQ ID NO: 7838 - protein, 15 aa, Homo Sapiens
AFAIYYIPLISLSIV

SEQ ID NO: 7839 - protein, 15 aa, Homo Sapiens
IPLISLSIVHRFGKQ

SEQ ID NO: 7840 - protein, 15 aa, Homo Sapiens
LSIVHRFGKQAPAYV

SEQ ID NO: 7841 - protein, 15 aa, Homo Sapiens
PAYVHTMIANTYLLI

SEQ ID NO: 7842 - protein, 15 aa, Homo Sapiens
TKQIRRAVIKILHSK

SEQ ID NO: 7843 - protein, 15 aa, Homo Sapiens
IKFFTVMESSVLLAM

SEQ ID NO: 7844 - protein, 15 aa, Homo Sapiens
FVAVSNPLRYAMILT

SEQ ID NO: 7845 - protein, 15 aa, Homo Sapiens
TAMFSTVGVDLLLIL

SEQ ID NO: 7846 - protein, 15 aa, Homo Sapiens
MNPVIYSVKTKQIRR

SEQ ID NO: 7847 - protein, 15 aa, Homo Sapiens
EISFNACLSHMFFIK

SEQ ID NO: 7848 - protein, 15 aa, Homo Sapiens
FDRFVAVSNPLRYAM

SEQ ID NO: 7849 - protein, 15 aa, Homo Sapiens
MKLSCTDTRINSAVG

SEQ ID NO: 7850 - protein, 15 aa, Homo Sapiens
YLLISPLMNPVIYSV

SEQ ID NO: 7851 - protein, 15 aa, Homo Sapiens
LLSYVLIIRTVLSVA

SEQ ID NO: 7852 - protein, 15 aa, Homo Sapiens
LISLSIVHRFGKQAP

SEQ ID NO: 7853 - protein, 15 aa, Homo Sapiens
AYVHTMIANTYLLIS

SEQ ID NO: 7854 - protein, 15 aa, Homo Sapiens
WFNVREISFNACLSH

SEQ ID NO: 7855 - protein, 15 aa, Homo Sapiens
FNVREISFNACLSHM

SEQ ID NO: 7856 - protein, 15 aa, Homo Sapiens
DLLLILLSYVLIIRT

SEQ ID NO: 7857 - protein, 15 aa, Homo Sapiens
SVASPEERKETFSTC

SEQ ID NO: 7858 - protein, 15 aa, Homo Sapiens
LVTMLSIFWFNVREI

SEQ ID NO: 7859 - protein, 15 aa, Homo Sapiens
LSIFWFNVREISFNA

SEQ ID NO: 7860 - protein, 15 aa, Homo Sapiens
SIFWFNVREISFNAC

SEQ ID NO: 7861 - protein, 15 aa, Homo Sapiens
FIKFFTVMESSVLLA

SEQ ID NO: 7862 - protein, 15 aa, Homo Sapiens
FFTVMESSVLLAMAF

SEQ ID NO: 7863 - protein, 15 aa, Homo Sapiens
LLMLTPMVALLIRLS

SEQ ID NO: 7864 - protein, 15 aa, Homo Sapiens
TVGVDLLLILLSYVL

SEQ ID NO: 7865 - protein, 15 aa, Homo Sapiens
GVDLLLILLSYVLII

SEQ ID NO: 7866 - protein, 15 aa, Homo Sapiens
LLLILLSYVLIIRTV

SEQ ID NO: 7867 - protein, 15 aa, Homo Sapiens
LSYVLIIRTVLSVAS

SEQ ID NO: 7868 - protein, 15 aa, Homo Sapiens
VLIIRTVLSVASPEE

SEQ ID NO: 7869 - protein, 15 aa, Homo Sapiens
YIPLISLSIVHRFGK

SEQ ID NO: 7870 - protein, 15 aa, Homo Sapiens
NTYLLISPLMNPVIY

SEQ ID NO: 7871 - protein, 15 aa, Homo Sapiens
TYLLISPLMNPVIYS

SEQ ID NO: 7872 - protein, 15 aa, Homo Sapiens
MYYFLSMLSATDLGL

SEQ ID NO: 7873 - protein, 15 aa, Homo Sapiens
KFFTVMESSVLLAMA

SEQ ID NO: 7874 - protein, 15 aa, Homo Sapiens
FTVMESSVLLAMAFD

SEQ ID NO: 7875 - protein, 15 aa, Homo Sapiens
ESSVLLAMAFDRFVA

SEQ ID NO: 7876 - protein, 15 aa, Homo Sapiens
VASVIRGLLMLTPMV

SEQ ID NO: 7877 - protein, 15 aa, Homo Sapiens
ASVIRGLLMLTPMVA

SEQ ID NO: 7878 - protein, 15 aa, Homo Sapiens
IRGLLMLTPMVALLI

SEQ ID NO: 7879 - protein, 15 aa, Homo Sapiens
LTPMVALLIRLSYCH

SEQ ID NO: 7880 - protein, 15 aa, Homo Sapiens
MVALLIRLSYCHSQV

SEQ ID NO: 7881 - protein, 15 aa, Homo Sapiens
HSQVLHHSYCYHPDV

SEQ ID NO: 7882 - protein, 15 aa, Homo Sapiens
LLILLSYVLIIRTVL

SEQ ID NO: 7883 - protein, 15 aa, Homo Sapiens
IRTVLSVASPEERKE

SEQ ID NO: 7884 - protein, 15 aa, Homo Sapiens
VHTMIANTYLLISPL

SEQ ID NO: 7885 - protein, 15 aa, Homo Sapiens
SMLSATDLGLSISTL

SEQ ID NO: 7886 - protein, 15 aa, Homo Sapiens
ATDLGLSISTLVTML

SEQ ID NO: 7887 - protein, 15 aa, Homo Sapiens
ISTLVTMLSIFWFNV

SEQ ID NO: 7888 - protein, 15 aa, Homo Sapiens
SNPLRYAMILTDSRI

SEQ ID NO: 7889 - protein, 15 aa, Homo Sapiens
RYAMILTDSRIAQIG

SEQ ID NO: 7890 - protein, 15 aa, Homo Sapiens
AMILTDSRIAQIGVA

SEQ ID NO: 7891 - protein, 15 aa, Homo Sapiens
DSRIAQIGVASVIRG

SEQ ID NO: 7892 - protein, 15 aa, Homo Sapiens
VALLIRLSYCHSQVL

SEQ ID NO: 7893 - protein, 15 aa, Homo Sapiens
ALLIRLSYCHSQVLH

SEQ ID NO: 7894 - protein, 15 aa, Homo Sapiens
SYCYHPDVMKLSCTD

SEQ ID NO: 7895 - protein, 15 aa, Homo Sapiens
PDVMKLSCTDTRINS

SEQ ID NO: 7896 - protein, 15 aa, Homo Sapiens
DTRINSAVGLTAMFS

SEQ ID NO: 7897 - protein, 15 aa, Homo Sapiens
VGVDLLLILLSYVLI

SEQ ID NO: 7898 - protein, 15 aa, Homo Sapiens
SYVLIIRTVLSVASP

SEQ ID NO: 7899 - protein, 15 aa, Homo Sapiens
IYYIPLISLSIVHRF

SEQ ID NO: 7900 - protein, 15 aa, Homo Sapiens
NPVIYSVKTKQIRRA

SEQ ID NO: 7901 - protein, 15 aa, Homo Sapiens
LSMLSATDLGLSIST

SEQ ID NO: 7902 - protein, 15 aa, Homo Sapiens
SATDLGLSISTLVTM

SEQ ID NO: 7903 - protein, 15 aa, Homo Sapiens
DLGLSISTLVTMLSI

SEQ ID NO: 7904 - protein, 15 aa, Homo Sapiens
LGLSISTLVTMLSIF

SEQ ID NO: 7905 - protein, 15 aa, Homo Sapiens
GLSISTLVTMLSIFW

SEQ ID NO: 7906 - protein, 15 aa, Homo Sapiens
VTMLSIFWFNVREIS

SEQ ID NO: 7907 - protein, 15 aa, Homo Sapiens
VREISFNACLSHMFF

SEQ ID NO: 7908 - protein, 15 aa, Homo Sapiens
LSHMFFIKFFTVMES

SEQ ID NO: 7909 - protein, 15 aa, Homo Sapiens
MFFIKFFTVMESSVL

SEQ ID NO: 7910 - protein, 15 aa, Homo Sapiens
SVLLAMAFDRFVAVS

SEQ ID NO: 7911 - protein, 15 aa, Homo Sapiens
IAQIGVASVIRGLLM

SEQ ID NO: 7912 - protein, 15 aa, Homo Sapiens
GVASVIRGLLMLTPM

SEQ ID NO: 7913 - protein, 15 aa, Homo Sapiens
HPDVMKLSCTDTRIN

SEQ ID NO: 7914 - protein, 15 aa, Homo Sapiens
CTDTRINSAVGLTAM

SEQ ID NO: 7915 - protein, 15 aa, Homo Sapiens
NSAVGLTAMFSTVGV

SEQ ID NO: 7916 - protein, 15 aa, Homo Sapiens
AVGLTAMFSTVGVDL

SEQ ID NO: 7917 - protein, 15 aa, Homo Sapiens
AMFSTVGVDLLLILL

SEQ ID NO: 7918 - protein, 15 aa, Homo Sapiens
STVGVDLLLILLSYV

SEQ ID NO: 7919 - protein, 15 aa, Homo Sapiens
LILLSYVLIIRTVLS

SEQ ID NO: 7920 - protein, 15 aa, Homo Sapiens
YVLIIRTVLSVASPE

SEQ ID NO: 7921 - protein, 15 aa, Homo Sapiens
RTVLSVASPEERKET

SEQ ID NO: 7922 - protein, 15 aa, Homo Sapiens
STCVSHIVAFAIYYI

SEQ ID NO: 7923 - protein, 15 aa, Homo Sapiens
VSHIVAFAIYYIPLI

SEQ ID NO: 7924 - protein, 15 aa, Homo Sapiens
SLSIVHRFGKQAPAY

SEQ ID NO: 7925 - protein, 15 aa, Homo Sapiens
HTMIANTYLLISPLM

SEQ ID NO: 7926 - protein, 15 aa, Homo Sapiens
SPLMNPVIYSVKTKQ

SEQ ID NO: 7927 - protein, 15 aa, Homo Sapiens
IYSVKTKQIRRAVIK

SEQ ID NO: 7928 - protein, 15 aa, Homo Sapiens
SISTLVTMLSIFWFN

SEQ ID NO: 7929 - protein, 15 aa, Homo Sapiens
MLSIFWFNVREISFN

SEQ ID NO: 7930 - protein, 15 aa, Homo Sapiens
HMFFIKFFTVMESSV

SEQ ID NO: 7931 - protein, 15 aa, Homo Sapiens
VMESSVLLAMAFDRF

SEQ ID NO: 7932 - protein, 15 aa, Homo Sapiens
CHSQVLHHSYCYHPD

SEQ ID NO: 7933 - protein, 15 aa, Homo Sapiens
SQVLHHSYCYHPDVM

SEQ ID NO: 7934 - protein, 15 aa, Homo Sapiens
VMKLSCTDTRINSAV

SEQ ID NO: 7935 - protein, 15 aa, Homo Sapiens
RINSAVGLTAMFSTV

SEQ ID NO: 7936 - protein, 15 aa, Homo Sapiens
TFSTCVSHIVAFAIY

SEQ ID NO: 7937 - protein, 15 aa, Homo Sapiens
SHIVAFAIYYIPLIS

SEQ ID NO: 7938 - protein, 15 aa, Homo Sapiens
MIANTYLLISPLMNP

SEQ ID NO: 7939 - protein, 15 aa, Homo Sapiens
LLISPLMNPVIYSVK

SEQ ID NO: 7940 - protein, 15 aa, Homo Sapiens
ISPLMNPVIYSVKTK

SEQ ID NO: 7941 - protein, 15 aa, Homo Sapiens
IFWFNVREISFNACL

SEQ ID NO: 7942 - protein, 15 aa, Homo Sapiens
ISFNACLSHMFFIKF

SEQ ID NO: 7943 - protein, 15 aa, Homo Sapiens
ACLSHMFFIKFFTVM

SEQ ID NO: 7944 - protein, 15 aa, Homo Sapiens
AMAFDRFVAVSNPLR

SEQ ID NO: 7945 - protein, 15 aa, Homo Sapiens
AFDRFVAVSNPLRYA

SEQ ID NO: 7946 - protein, 15 aa, Homo Sapiens
AVSNPLRYAMILTDS

SEQ ID NO: 7947 - protein, 15 aa, Homo Sapiens
AQIGVASVIRGLLML

SEQ ID NO: 7948 - protein, 15 aa, Homo Sapiens
MLTPMVALLIRLSYC

SEQ ID NO: 7949 - protein, 15 aa, Homo Sapiens
IRLSYCHSQVLHHSY

SEQ ID NO: 7950 - protein, 15 aa, Homo Sapiens
SYCHSQVLHHSYCYH

SEQ ID NO: 7951 - protein, 15 aa, Homo Sapiens
HSYCYHPDVMKLSCT

SEQ ID NO: 7952 - protein, 15 aa, Homo Sapiens
TCVSHIVAFAIYYIP

SEQ ID NO: 7953 - protein, 15 aa, Homo Sapiens
CVSHIVAFAIYYIPL

SEQ ID NO: 7954 - protein, 15 aa, Homo Sapiens
IVAFAIYYIPLISLS

SEQ ID NO: 7955 - protein, 15 aa, Homo Sapiens
SIVHRFGKQAPAYVH

SEQ ID NO: 7956 - protein, 15 aa, Homo Sapiens
IVHRFGKQAPAYVHT

SEQ ID NO: 7957 - protein, 15 aa, Homo Sapiens
VHRFGKQAPAYVHTM

SEQ ID NO: 7958 - protein, 15 aa, Homo Sapiens
YVHTMIANTYLLISP

SEQ ID NO: 7959 - protein, 15 aa, Homo Sapiens
TMLSIFWFNVREISF

SEQ ID NO: 7960 - protein, 15 aa, Homo Sapiens
SHMFFIKFFTVMESS

SEQ ID NO: 7961 - protein, 15 aa, Homo Sapiens
TVLSVASPEERKETF

SEQ ID NO: 7962 - protein, 15 aa, Homo Sapiens
LSVASPEERKETFST

SEQ ID NO: 7963 - protein, 15 aa, Homo Sapiens
VASPEERKETFSTCV

SEQ ID NO: 7964 - protein, 15 aa, Homo Sapiens
KETFSTCVSHIVAFA

SEQ ID NO: 7965 - protein, 15 aa, Homo Sapiens
HIVAFAIYYIPLISL

SEQ ID NO: 7966 - protein, 15 aa, Homo Sapiens
VIYSVKTKQIRRAVI

SEQ ID NO: 7967 - protein, 15 aa, Homo Sapiens
YSVKTKQIRRAVIKI

SEQ ID NO: 7968 - protein, 15 aa, Homo Sapiens
SVKTKQIRRAVIKIL

SEQ ID NO: 7969 - protein, 15 aa, Homo Sapiens
KQIRRAVIKILHSKE

SEQ ID NO: 7970 - protein, 15 aa, Homo Sapiens
YCYHPDVMKLSCTDT

SEQ ID NO: 7971 - protein, 15 aa, Homo Sapiens
LSCTDTRINSAVGLT

SEQ ID NO: 7972 - protein, 15 aa, Homo Sapiens
PVIYSVKTKQIRRAV

SEQ ID NO: 7973 - protein, 15 aa, Homo Sapiens
CLSHMFFIKFFTVME

SEQ ID NO: 7974 - protein, 15 aa, Homo Sapiens
VLLAMAFDRFVAVSN

SEQ ID NO: 7975 - protein, 15 aa, Homo Sapiens
ILTDSRIAQIGVASV

SEQ ID NO: 7976 - protein, 15 aa, Homo Sapiens
TDLGLSISTLVTMLS

SEQ ID NO: 7977 - protein, 15 aa, Homo Sapiens
ANTYLLISPLMNPVI

SEQ ID NO: 7978 - protein, 15 aa, Homo Sapiens
VIRGLLMLTPMVALL

SEQ ID NO: 7979 - protein, 15 aa, Homo Sapiens
LISPLMNPVIYSVKT

SEQ ID NO: 7980 - protein, 15 aa, Homo Sapiens
LSISTLVTMLSIFWF

SEQ ID NO: 7981 - protein, 15 aa, Homo Sapiens
NVREISFNACLSHMF

SEQ ID NO: 7982 - protein, 15 aa, Homo Sapiens
FNACLSHMFFIKFFT

SEQ ID NO: 7983 - protein, 15 aa, Homo Sapiens
TVMESSVLLAMAFDR

SEQ ID NO: 7984 - protein, 15 aa, Homo Sapiens
MESSVLLAMAFDRFV

SEQ ID NO: 7985 - protein, 15 aa, Homo Sapiens
RFVAVSNPLRYAMIL

SEQ ID NO: 7986 - protein, 15 aa, Homo Sapiens
VSNPLRYAMILTDSR

SEQ ID NO: 7987 - protein, 15 aa, Homo Sapiens
TDSRIAQIGVASVIR

SEQ ID NO: 7988 - protein, 15 aa, Homo Sapiens
PMVALLIRLSYCHSQ

SEQ ID NO: 7989 - protein, 15 aa, Homo Sapiens
LLIRLSYCHSQVLHH

SEQ ID NO: 7990 - protein, 15 aa, Homo Sapiens
YHPDVMKLSCTDTRI

SEQ ID NO: 7991 - protein, 15 aa, Homo Sapiens
DVMKLSCTDTRINSA

SEQ ID NO: 7992 - protein, 15 aa, Homo Sapiens
VGLTAMFSTVGVDLL

SEQ ID NO: 7993 - protein, 15 aa, Homo Sapiens
MFSTVGVDLLLILLS

SEQ ID NO: 7994 - protein, 15 aa, Homo Sapiens
LIIRTVLSVASPEER

SEQ ID NO: 7995 - protein, 15 aa, Homo Sapiens
FSTCVSHIVAFAIYY

SEQ ID NO: 7996 - protein, 15 aa, Homo Sapiens
AIYYIPLISLSIVHR

SEQ ID NO: 7997 - protein, 15 aa, Homo Sapiens
YYIPLISLSIVHRFG

SEQ ID NO: 7998 - protein, 15 aa, Homo Sapiens
PLISLSIVHRFGKQA

SEQ ID NO: 7999 - protein, 15 aa, Homo Sapiens
APAYVHTMIANTYLL

SEQ ID NO: 8000 - protein, 15 aa, Homo Sapiens
YFLSMLSATDLGLSI

SEQ ID NO: 8001 - protein, 15 aa, Homo Sapiens
MLSATDLGLSISTLV

SEQ ID NO: 8002 - protein, 15 aa, Homo Sapiens
LSATDLGLSISTLVT

SEQ ID NO: 8003 - protein, 15 aa, Homo Sapiens
FWFNVREISFNACLS

SEQ ID NO: 8004 - protein, 15 aa, Homo Sapiens
MAFDRFVAVSNPLRY

SEQ ID NO: 8005 - protein, 15 aa, Homo Sapiens
VAVSNPLRYAMILTD

SEQ ID NO: 8006 - protein, 15 aa, Homo Sapiens
PLRYAMILTDSRIAQ

SEQ ID NO: 8007 - protein, 15 aa, Homo Sapiens
MILTDSRIAQIGVAS

SEQ ID NO: 8008 - protein, 15 aa, Homo Sapiens
RIAQIGVASVIRGLL

SEQ ID NO: 8009 - protein, 15 aa, Homo Sapiens
IGVASVIRGLLMLTP

SEQ ID NO: 8010 - protein, 15 aa, Homo Sapiens
LMLTPMVALLIRLSY

SEQ ID NO: 8011 - protein, 15 aa, Homo Sapiens
HHSYCYHPDVMKLSC

SEQ ID NO: 8012 - protein, 15 aa, Homo Sapiens
KLSCTDTRINSAVGL

SEQ ID NO: 8013 - protein, 15 aa, Homo Sapiens
SCTDTRINSAVGLTA

SEQ ID NO: 8014 - protein, 15 aa, Homo Sapiens
TDTRINSAVGLTAMF

SEQ ID NO: 8015 - protein, 15 aa, Homo Sapiens
TRINSAVGLTAMFST

SEQ ID NO: 8016 - protein, 15 aa, Homo Sapiens
SAVGLTAMFSTVGVD

SEQ ID NO: 8017 - protein, 15 aa, Homo Sapiens
IIRTVLSVASPEERK

SEQ ID NO: 8018 - protein, 15 aa, Homo Sapiens
PEERKETFSTCVSHI

SEQ ID NO: 8019 - protein, 15 aa, Homo Sapiens
ERKETFSTCVSHIVA

SEQ ID NO: 8020 - protein, 15 aa, Homo Sapiens
ETFSTCVSHIVAFAI

SEQ ID NO: 8021 - protein, 15 aa, Homo Sapiens
VAFAIYYIPLISLSI

SEQ ID NO: 8022 - protein, 15 aa, Homo Sapiens
FAIYYIPLISLSIVH

SEQ ID NO: 8023 - protein, 15 aa, Homo Sapiens
ISLSIVHRFGKQAPA

SEQ ID NO: 8024 - protein, 15 aa, Homo Sapiens
HRFGKQAPAYVHTMI

SEQ ID NO: 8025 - protein, 15 aa, Homo Sapiens
IANTYLLISPLMNPV

SEQ ID NO: 8026 - protein, 15 aa, Homo Sapiens
PLMNPVIYSVKTKQI

SEQ ID NO: 8027 - protein, 15 aa, Homo Sapiens
LMNPVIYSVKTKQIR

SEQ ID NO: 8028 - protein, 15 aa, Homo Sapiens
KTKQIRRAVIKILHS

SEQ ID NO: 8029 - protein, 15 aa, Homo Sapiens
QIRRAVIKILHSKET

SEQ ID NO: 8030 - protein, 15 aa, Homo Sapiens
TLVTMLSIFWFNVRE

SEQ ID NO: 8031 - protein, 15 aa, Homo Sapiens
SFNACLSHMFFIKFF

SEQ ID NO: 8032 - protein, 15 aa, Homo Sapiens
LAMAFDRFVAVSNPL

SEQ ID NO: 8033 - protein, 15 aa, Homo Sapiens
LTDSRIAQIGVASVI

SEQ ID NO: 8034 - protein, 15 aa, Homo Sapiens
SVIRGLLMLTPMVAL

SEQ ID NO: 8035 - protein, 15 aa, Homo Sapiens
RLSYCHSQVLHHSYC

SEQ ID NO: 8036 - protein, 15 aa, Homo Sapiens
LSYCHSQVLHHSYCY

SEQ ID NO: 8037 - protein, 15 aa, Homo Sapiens
QVLHHSYCYHPDVMK

SEQ ID NO: 8038 - protein, 15 aa, Homo Sapiens
CYHPDVMKLSCTDTR

SEQ ID NO: 8039 - protein, 15 aa, Homo Sapiens
INSAVGLTAMFSTVG

SEQ ID NO: 8040 - protein, 15 aa, Homo Sapiens
ASPEERKETFSTCVS

SEQ ID NO: 8041 - protein, 15 aa, Homo Sapiens
SPEERKETFSTCVSH

SEQ ID NO: 8042 - protein, 15 aa, Homo Sapiens
EERKETFSTCVSHIV

SEQ ID NO: 8043 - protein, 15 aa, Homo Sapiens
RKETFSTCVSHIVAF

SEQ ID NO: 8044 - protein, 15 aa, Homo Sapiens
RFGKQAPAYVHTMIA

SEQ ID NO: 8045 - protein, 15 aa, Homo Sapiens
FGKQAPAYVHTMIAN

SEQ ID NO: 8046 - protein, 15 aa, Homo Sapiens
QAPAYVHTMIANTYL

SEQ ID NO: 8047 - protein, 15 aa, Homo Sapiens
TMIANTYLLISPLMN

SEQ ID NO: 8048 - protein, 15 aa, Homo Sapiens
VKTKQIRRAVIKILH

SEQ ID NO: 8049 - protein, 15 aa, Homo Sapiens
LLSYVLIIRTVLSVA

SEQ ID NO: 8050 - protein, 15 aa, Homo Sapiens
AIYYIPLISLSIVHR

SEQ ID NO: 8051 - protein, 15 aa, Homo Sapiens
GLSISTLVTMLSIFW

SEQ ID NO: 8052 - protein, 15 aa, Homo Sapiens
YAMILTDSRIAQIGV

SEQ ID NO: 8053 - protein, 15 aa, Homo Sapiens
QIGVASVIRGLLMLT

SEQ ID NO: 8054 - protein, 15 aa, Homo Sapiens
VDLLLILLSYVLIIR

SEQ ID NO: 8055 - protein, 15 aa, Homo Sapiens
LSYVLIIRTVLSVAS

SEQ ID NO: 8056 - protein, 15 aa, Homo Sapiens
VLIIRTVLSVASPEE

SEQ ID NO: 8057 - protein, 15 aa, Homo Sapiens
LISLSIVHRFGKQAP

SEQ ID NO: 8058 - protein, 15 aa, Homo Sapiens
YLLISPLMNPVIYSV

SEQ ID NO: 8059 - protein, 15 aa, Homo Sapiens
NPVIYSVKTKQIRRA

SEQ ID NO: 8060 - protein, 15 aa, Homo Sapiens
LSIFWFNVREISFNA

SEQ ID NO: 8061 - protein, 15 aa, Homo Sapiens
HMFFIKFFTVMESSV

SEQ ID NO: 8062 - protein, 15 aa, Homo Sapiens
FIKFFTVMESSVLLA

SEQ ID NO: 8063 - protein, 15 aa, Homo Sapiens
IKFFTVMESSVLLAM

SEQ ID NO: 8064 - protein, 15 aa, Homo Sapiens
AMAFDRFVAVSNPLR

SEQ ID NO: 8065 - protein, 15 aa, Homo Sapiens
FDRFVAVSNPLRYAM

SEQ ID NO: 8066 - protein, 15 aa, Homo Sapiens
PLRYAMILTDSRIAQ

SEQ ID NO: 8067 - protein, 15 aa, Homo Sapiens
SYCYHPDVMKLSCTD

SEQ ID NO: 8068 - protein, 15 aa, Homo Sapiens
TAMFSTVGVDLLLIL

SEQ ID NO: 8069 - protein, 15 aa, Homo Sapiens
KETFSTCVSHIVAFA

SEQ ID NO: 8070 - protein, 15 aa, Homo Sapiens
ANTYLLISPLMNPVI

SEQ ID NO: 8071 - protein, 15 aa, Homo Sapiens
YYFLSMLSATDLGLS

SEQ ID NO: 8072 - protein, 15 aa, Homo Sapiens
FLSMLSATDLGLSIS

SEQ ID NO: 8073 - protein, 15 aa, Homo Sapiens
ATDLGLSISTLVTML

SEQ ID NO: 8074 - protein, 15 aa, Homo Sapiens
LVTMLSIFWFNVREI

SEQ ID NO: 8075 - protein, 15 aa, Homo Sapiens
MLSIFWFNVREISFN

SEQ ID NO: 8076 - protein, 15 aa, Homo Sapiens
LSHMFFIKFFTVMES

SEQ ID NO: 8077 - protein, 15 aa, Homo Sapiens
MFFIKFFTVMESSVL

SEQ ID NO: 8078 - protein, 15 aa, Homo Sapiens
SVLLAMAFDRFVAVS

SEQ ID NO: 8079 - protein, 15 aa, Homo Sapiens
LLAMAFDRFVAVSNP

SEQ ID NO: 8080 - protein, 15 aa, Homo Sapiens
FVAVSNPLRYAMILT

SEQ ID NO: 8081 - protein, 15 aa, Homo Sapiens
RYAMILTDSRIAQIG

SEQ ID NO: 8082 - protein, 15 aa, Homo Sapiens
DSRIAQIGVASVIRG

SEQ ID NO: 8083 - protein, 15 aa, Homo Sapiens
IRGLLMLTPMVALLI

SEQ ID NO: 8084 - protein, 15 aa, Homo Sapiens
LTPMVALLIRLSYCH

SEQ ID NO: 8085 - protein, 15 aa, Homo Sapiens
TPMVALLIRLSYCHS

SEQ ID NO: 8086 - protein, 15 aa, Homo Sapiens
VALLIRLSYCHSQVL

SEQ ID NO: 8087 - protein, 15 aa, Homo Sapiens
LIRLSYCHSQVLHHS

SEQ ID NO: 8088 - protein, 15 aa, Homo Sapiens
HPDVMKLSCTDTRIN

SEQ ID NO: 8089 - protein, 15 aa, Homo Sapiens
VMKLSCTDTRINSAV

SEQ ID NO: 8090 - protein, 15 aa, Homo Sapiens
DTRINSAVGLTAMFS

SEQ ID NO: 8091 - protein, 15 aa, Homo Sapiens
FSTVGVDLLLILLSY

SEQ ID NO: 8092 - protein, 15 aa, Homo Sapiens
TVGVDLLLILLSYVL

SEQ ID NO: 8093 - protein, 15 aa, Homo Sapiens
GVDLLLILLSYVLII

SEQ ID NO: 8094 - protein, 15 aa, Homo Sapiens
DLLLILLSYVLIIRT

SEQ ID NO: 8095 - protein, 15 aa, Homo Sapiens
LILLSYVLIIRTVLS

SEQ ID NO: 8096 - protein, 15 aa, Homo Sapiens
IRTVLSVASPEERKE

SEQ ID NO: 8097 - protein, 15 aa, Homo Sapiens
STCVSHIVAFAIYYI

SEQ ID NO: 8098 - protein, 15 aa, Homo Sapiens
VSHIVAFAIYYIPLI

SEQ ID NO: 8099 - protein, 15 aa, Homo Sapiens
AFAIYYIPLISLSIV

SEQ ID NO: 8100 - protein, 15 aa, Homo Sapiens
IYYIPLISLSIVHRF

SEQ ID NO: 8101 - protein, 15 aa, Homo Sapiens
SPLMNPVIYSVKTKQ

SEQ ID NO: 8102 - protein, 15 aa, Homo Sapiens
TKQIRRAVIKILHSK

SEQ ID NO: 8103 - protein, 15 aa, Homo Sapiens
TDLGLSISTLVTMLS

SEQ ID NO: 8104 - protein, 15 aa, Homo Sapiens
FWFNVREISFNACLS

SEQ ID NO: 8105 - protein, 15 aa, Homo Sapiens
KFFTVMESSVLLAMA

SEQ ID NO: 8106 - protein, 15 aa, Homo Sapiens
VLLAMAFDRFVAVSN

SEQ ID NO: 8107 - protein, 15 aa, Homo Sapiens
AFDRFVAVSNPLRYA

SEQ ID NO: 8108 - protein, 15 aa, Homo Sapiens
ILTDSRIAQIGVASV

SEQ ID NO: 8109 - protein, 15 aa, Homo Sapiens
MKLSCTDTRINSAVG

SEQ ID NO: 8110 - protein, 15 aa, Homo Sapiens
VGLTAMFSTVGVDLL

SEQ ID NO: 8111 - protein, 15 aa, Homo Sapiens
LSVASPEERKETFST

SEQ ID NO: 8112 - protein, 15 aa, Homo Sapiens
EERKETFSTCVSHIV

SEQ ID NO: 8113 - protein, 15 aa, Homo Sapiens
ETFSTCVSHIVAFAI

SEQ ID NO: 8114 - protein, 15 aa, Homo Sapiens
KQAPAYVHTMIANTY

SEQ ID NO: 8115 - protein, 15 aa, Homo Sapiens
AYVHTMIANTYLLIS

SEQ ID NO: 8116 - protein, 15 aa, Homo Sapiens
YVHTMIANTYLLISP

SEQ ID NO: 8117 - protein, 15 aa, Homo Sapiens
IANTYLLISPLMNPV

SEQ ID NO: 8118 - protein, 15 aa, Homo Sapiens
PLMNPVIYSVKTKQI

SEQ ID NO: 8119 - protein, 15 aa, Homo Sapiens
SVKTKQIRRAVIKIL

SEQ ID NO: 8120 - protein, 15 aa, Homo Sapiens
MYYFLSMLSATDLGL

SEQ ID NO: 8121 - protein, 15 aa, Homo Sapiens
SIFWFNVREISFNAC

SEQ ID NO: 8122 - protein, 15 aa, Homo Sapiens
EISFNACLSHMFFIK

SEQ ID NO: 8123 - protein, 15 aa, Homo Sapiens
HHSYCYHPDVMKLSC

SEQ ID NO: 8124 - protein, 15 aa, Homo Sapiens
IVAFAIYYIPLISLS

SEQ ID NO: 8125 - protein, 15 aa, Homo Sapiens
FAIYYIPLISLSIVH

SEQ ID NO: 8126 - protein, 15 aa, Homo Sapiens
VHRFGKQAPAYVHTM

SEQ ID NO: 8127 - protein, 15 aa, Homo Sapiens
APAYVHTMIANTYLL

SEQ ID NO: 8128 - protein, 15 aa, Homo Sapiens
LSMLSATDLGLSIST

SEQ ID NO: 8129 - protein, 15 aa, Homo Sapiens
DLGLSISTLVTMLSI

SEQ ID NO: 8130 - protein, 15 aa, Homo Sapiens
ISTLVTMLSIFWFNV

SEQ ID NO: 8131 - protein, 15 aa, Homo Sapiens
STLVTMLSIFWFNVR

SEQ ID NO: 8132 - protein, 15 aa, Homo Sapiens
VTMLSIFWFNVREIS

SEQ ID NO: 8133 - protein, 15 aa, Homo Sapiens
WFNVREISFNACLSH

SEQ ID NO: 8134 - protein, 15 aa, Homo Sapiens
FFTVMESSVLLAMAF

SEQ ID NO: 8135 - protein, 15 aa, Homo Sapiens
FTVMESSVLLAMAFD

SEQ ID NO: 8136 - protein, 15 aa, Homo Sapiens
ESSVLLAMAFDRFVA

SEQ ID NO: 8137 - protein, 15 aa, Homo Sapiens
SNPLRYAMILTDSRI

SEQ ID NO: 8138 - protein, 15 aa, Homo Sapiens
AMILTDSRIAQIGVA

SEQ ID NO: 8139 - protein, 15 aa, Homo Sapiens
IAQIGVASVIRGLLM

SEQ ID NO: 8140 - protein, 15 aa, Homo Sapiens
VASVIRGLLMLTPMV

SEQ ID NO: 8141 - protein, 15 aa, Homo Sapiens
ASVIRGLLMLTPMVA

SEQ ID NO: 8142 - protein, 15 aa, Homo Sapiens
RGLLMLTPMVALLIR

SEQ ID NO: 8143 - protein, 15 aa, Homo Sapiens
GLLMLTPMVALLIRL

SEQ ID NO: 8144 - protein, 15 aa, Homo Sapiens
LLMLTPMVALLIRLS

SEQ ID NO: 8145 - protein, 15 aa, Homo Sapiens
ALLIRLSYCHSQVLH

SEQ ID NO: 8146 - protein, 15 aa, Homo Sapiens
PDVMKLSCTDTRINS

SEQ ID NO: 8147 - protein, 15 aa, Homo Sapiens
NSAVGLTAMFSTVGV

SEQ ID NO: 8148 - protein, 15 aa, Homo Sapiens
AVGLTAMFSTVGVDL

SEQ ID NO: 8149 - protein, 15 aa, Homo Sapiens
LTAMFSTVGVDLLLI

SEQ ID NO: 8150 - protein, 15 aa, Homo Sapiens
LLLILLSYVLIIRTV

SEQ ID NO: 8151 - protein, 15 aa, Homo Sapiens
YVLIIRTVLSVASPE

SEQ ID NO: 8152 - protein, 15 aa, Homo Sapiens
RTVLSVASPEERKET

SEQ ID NO: 8153 - protein, 15 aa, Homo Sapiens
SHIVAFAIYYIPLIS

SEQ ID NO: 8154 - protein, 15 aa, Homo Sapiens
YIPLISLSIVHRFGK

SEQ ID NO: 8155 - protein, 15 aa, Homo Sapiens
LSIVHRFGKQAPAYV

SEQ ID NO: 8156 - protein, 15 aa, Homo Sapiens
VHTMIANTYLLISPL

SEQ ID NO: 8157 - protein, 15 aa, Homo Sapiens
HTMIANTYLLISPLM

SEQ ID NO: 8158 - protein, 15 aa, Homo Sapiens
TYLLISPLMNPVIYS

SEQ ID NO: 8159 - protein, 15 aa, Homo Sapiens
ISPLMNPVIYSVKTK

SEQ ID NO: 8160 - protein, 15 aa, Homo Sapiens
MNPVIYSVKTKQIRR

SEQ ID NO: 8161 - protein, 15 aa, Homo Sapiens
SMLSATDLGLSISTL

SEQ ID NO: 8162 - protein, 15 aa, Homo Sapiens
MLSATDLGLSISTLV

SEQ ID NO: 8163 - protein, 15 aa, Homo Sapiens
LSATDLGLSISTLVT

SEQ ID NO: 8164 - protein, 15 aa, Homo Sapiens
SATDLGLSISTLVTM

SEQ ID NO: 8165 - protein, 15 aa, Homo Sapiens
LSISTLVTMLSIFWF

SEQ ID NO: 8166 - protein, 15 aa, Homo Sapiens
FNVREISFNACLSHM

SEQ ID NO: 8167 - protein, 15 aa, Homo Sapiens
NVREISFNACLSHMF

SEQ ID NO: 8168 - protein, 15 aa, Homo Sapiens
REISFNACLSHMFFI

SEQ ID NO: 8169 - protein, 15 aa, Homo Sapiens
ISFNACLSHMFFIKF

SEQ ID NO: 8170 - protein, 15 aa, Homo Sapiens
CLSHMFFIKFFTVME

SEQ ID NO: 8171 - protein, 15 aa, Homo Sapiens
TVMESSVLLAMAFDR

SEQ ID NO: 8172 - protein, 15 aa, Homo Sapiens
VAVSNPLRYAMILTD

SEQ ID NO: 8173 - protein, 15 aa, Homo Sapiens
LRYAMILTDSRIAQI

SEQ ID NO: 8174 - protein, 15 aa, Homo Sapiens
LTDSRIAQIGVASVI

SEQ ID NO: 8175 - protein, 15 aa, Homo Sapiens
RIAQIGVASVIRGLL

SEQ ID NO: 8176 - protein, 15 aa, Homo Sapiens
IGVASVIRGLLMLTP

SEQ ID NO: 8177 - protein, 15 aa, Homo Sapiens
SVIRGLLMLTPMVAL

SEQ ID NO: 8178 - protein, 15 aa, Homo Sapiens
VIRGLLMLTPMVALL

SEQ ID NO: 8179 - protein, 15 aa, Homo Sapiens
MLTPMVALLIRLSYC

SEQ ID NO: 8180 - protein, 15 aa, Homo Sapiens
LLIRLSYCHSQVLHH

SEQ ID NO: 8181 - protein, 15 aa, Homo Sapiens
SYCHSQVLHHSYCYH

SEQ ID NO: 8182 - protein, 15 aa, Homo Sapiens
YCHSQVLHHSYCYHP

SEQ ID NO: 8183 - protein, 15 aa, Homo Sapiens
VLHHSYCYHPDVMKL

SEQ ID NO: 8184 - protein, 15 aa, Homo Sapiens
SCTDTRINSAVGLTA

SEQ ID NO: 8185 - protein, 15 aa, Homo Sapiens
TRINSAVGLTAMFST

SEQ ID NO: 8186 - protein, 15 aa, Homo Sapiens
INSAVGLTAMFSTVG

SEQ ID NO: 8187 - protein, 15 aa, Homo Sapiens
SAVGLTAMFSTVGVD

SEQ ID NO: 8188 - protein, 15 aa, Homo Sapiens
MFSTVGVDLLLILLS

SEQ ID NO: 8189 - protein, 15 aa, Homo Sapiens
STVGVDLLLILLSYV

SEQ ID NO: 8190 - protein, 15 aa, Homo Sapiens
ILLSYVLIIRTVLSV

SEQ ID NO: 8191 - protein, 15 aa, Homo Sapiens
PEERKETFSTCVSHI

SEQ ID NO: 8192 - protein, 15 aa, Homo Sapiens
HIVAFAIYYIPLISL

SEQ ID NO: 8193 - protein, 15 aa, Homo Sapiens
PLISLSIVHRFGKQA

SEQ ID NO: 8194 - protein, 15 aa, Homo Sapiens
SIVHRFGKQAPAYVH

SEQ ID NO: 8195 - protein, 15 aa, Homo Sapiens
FGKQAPAYVHTMIAN

SEQ ID NO: 8196 - protein, 15 aa, Homo Sapiens
GKQAPAYVHTMIANT

SEQ ID NO: 8197 - protein, 15 aa, Homo Sapiens
MIANTYLLISPLMNP

SEQ ID NO: 8198 - protein, 15 aa, Homo Sapiens
YSVKTKQIRRAVIKI

SEQ ID NO: 8199 - protein, 15 aa, Homo Sapiens
QIRRAVIKILHSKET

SEQ ID NO: 8200 - protein, 15 aa, Homo Sapiens
IFWFNVREISFNACL

SEQ ID NO: 8201 - protein, 15 aa, Homo Sapiens
SHMFFIKFFTVMESS

SEQ ID NO: 8202 - protein, 15 aa, Homo Sapiens
RLSYCHSQVLHHSYC

SEQ ID NO: 8203 - protein, 15 aa, Homo Sapiens
MVALLIRLSYCHSQV

SEQ ID NO: 8204 - protein, 15 aa, Homo Sapiens
SYVLIIRTVLSVASP

SEQ ID NO: 8205 - protein, 15 aa, Homo Sapiens
SLSIVHRFGKQAPAY

SEQ ID NO: 8206 - protein, 15 aa, Homo Sapiens
IYSVKTKQIRRAVIK

SEQ ID NO: 8207 - protein, 15 aa, Homo Sapiens
VREISFNACLSHMFF

SEQ ID NO: 8208 - protein, 15 aa, Homo Sapiens
NACLSHMFFIKFFTV

SEQ ID NO: 8209 - protein, 15 aa, Homo Sapiens
SSVLLAMAFDRFVAV

SEQ ID NO: 8210 - protein, 15 aa, Homo Sapiens
DRFVAVSNPLRYAMI

SEQ ID NO: 8211 - protein, 15 aa, Homo Sapiens
HSQVLHHSYCYHPDV

SEQ ID NO: 8212 - protein, 15 aa, Homo Sapiens
SQVLHHSYCYHPDVM

SEQ ID NO: 8213 - protein, 15 aa, Homo Sapiens
LLILLSYVLIIRTVL

SEQ ID NO: 8214 - protein, 15 aa, Homo Sapiens
VLSVASPEERKETFS

SEQ ID NO: 8215 - protein, 15 aa, Homo Sapiens
IPLISLSIVHRFGKQ

SEQ ID NO: 8216 - protein, 15 aa, Homo Sapiens
PAYVHTMIANTYLLI

SEQ ID NO: 8217 - protein, 15 aa, Homo Sapiens
NTYLLISPLMNPVIY

SEQ ID NO: 8218 - protein, 15 aa, Homo Sapiens
LSCTDTRINSAVGLT

SEQ ID NO: 8219 - protein, 15 aa, Homo Sapiens
ASPEERKETFSTCVS

SEQ ID NO: 8220 - protein, 15 aa, Homo Sapiens
YFLSMLSATDLGLSI

SEQ ID NO: 8221 - protein, 15 aa, Homo Sapiens
LGLSISTLVTMLSIF

SEQ ID NO: 8222 - protein, 15 aa, Homo Sapiens
TLVTMLSIFWFNVRE

SEQ ID NO: 8223 - protein, 15 aa, Homo Sapiens
TMLSIFWFNVREISF

SEQ ID NO: 8224 - protein, 15 aa, Homo Sapiens
SFNACLSHMFFIKFF

SEQ ID NO: 8225 - protein, 15 aa, Homo Sapiens
FNACLSHMFFIKFFT

SEQ ID NO: 8226 - protein, 15 aa, Homo Sapiens
ACLSHMFFIKFFTVM

SEQ ID NO: 8227 - protein, 15 aa, Homo Sapiens
FFIKFFTVMESSVLL

SEQ ID NO: 8228 - protein, 15 aa, Homo Sapiens
VMESSVLLAMAFDRF

SEQ ID NO: 8229 - protein, 15 aa, Homo Sapiens
MESSVLLAMAFDRFV

SEQ ID NO: 8230 - protein, 15 aa, Homo Sapiens
MAFDRFVAVSNPLRY

SEQ ID NO: 8231 - protein, 15 aa, Homo Sapiens
RFVAVSNPLRYAMIL

SEQ ID NO: 8232 - protein, 15 aa, Homo Sapiens
VSNPLRYAMILTDSR

SEQ ID NO: 8233 - protein, 15 aa, Homo Sapiens
NPLRYAMILTDSRIA

SEQ ID NO: 8234 - protein, 15 aa, Homo Sapiens
TDSRIAQIGVASVIR

SEQ ID NO: 8235 - protein, 15 aa, Homo Sapiens
SRIAQIGVASVIRGL

SEQ ID NO: 8236 - protein, 15 aa, Homo Sapiens
AQIGVASVIRGLLML

SEQ ID NO: 8237 - protein, 15 aa, Homo Sapiens
LMLTPMVALLIRLSY

SEQ ID NO: 8238 - protein, 15 aa, Homo Sapiens
PMVALLIRLSYCHSQ

SEQ ID NO: 8239 - protein, 15 aa, Homo Sapiens
IRLSYCHSQVLHHSY

SEQ ID NO: 8240 - protein, 15 aa, Homo Sapiens
LSYCHSQVLHHSYCY

SEQ ID NO: 8241 - protein, 15 aa, Homo Sapiens
CHSQVLHHSYCYHPD

SEQ ID NO: 8242 - protein, 15 aa, Homo Sapiens
LHHSYCYHPDVMKLS

SEQ ID NO: 8243 - protein, 15 aa, Homo Sapiens
HSYCYHPDVMKLSCT

SEQ ID NO: 8244 - protein, 15 aa, Homo Sapiens
YCYHPDVMKLSCTDT

SEQ ID NO: 8245 - protein, 15 aa, Homo Sapiens
CYHPDVMKLSCTDTR

SEQ ID NO: 8246 - protein, 15 aa, Homo Sapiens
DVMKLSCTDTRINSA

SEQ ID NO: 8247 - protein, 15 aa, Homo Sapiens
KLSCTDTRINSAVGL

SEQ ID NO: 8248 - protein, 15 aa, Homo Sapiens
CTDTRINSAVGLTAM

SEQ ID NO: 8249 - protein, 15 aa, Homo Sapiens
TDTRINSAVGLTAMF

SEQ ID NO: 8250 - protein, 15 aa, Homo Sapiens
RINSAVGLTAMFSTV

SEQ ID NO: 8251 - protein, 15 aa, Homo Sapiens
AMFSTVGVDLLLILL

SEQ ID NO: 8252 - protein, 15 aa, Homo Sapiens
VGVDLLLILLSYVLI

SEQ ID NO: 8253 - protein, 15 aa, Homo Sapiens
LIIRTVLSVASPEER

SEQ ID NO: 8254 - protein, 15 aa, Homo Sapiens
TVLSVASPEERKETF

SEQ ID NO: 8255 - protein, 15 aa, Homo Sapiens
SVASPEERKETFSTC

SEQ ID NO: 8256 - protein, 15 aa, Homo Sapiens
SPEERKETFSTCVSH

SEQ ID NO: 8257 - protein, 15 aa, Homo Sapiens
RKETFSTCVSHIVAF

SEQ ID NO: 8258 - protein, 15 aa, Homo Sapiens
FSTCVSHIVAFAIYY

SEQ ID NO: 8259 - protein, 15 aa, Homo Sapiens
TCVSHIVAFAIYYIP

SEQ ID NO: 8260 - protein, 15 aa, Homo Sapiens
CVSHIVAFAIYYIPL

SEQ ID NO: 8261 - protein, 15 aa, Homo Sapiens
VAFAIYYIPLISLSI

SEQ ID NO: 8262 - protein, 15 aa, Homo Sapiens
YYIPLISLSIVHRFG

SEQ ID NO: 8263 - protein, 15 aa, Homo Sapiens
ISLSIVHRFGKQAPA

SEQ ID NO: 8264 - protein, 15 aa, Homo Sapiens
HRFGKQAPAYVHTMI

SEQ ID NO: 8265 - protein, 15 aa, Homo Sapiens
RFGKQAPAYVHTMIA

SEQ ID NO: 8266 - protein, 15 aa, Homo Sapiens
QAPAYVHTMIANTYL

SEQ ID NO: 8267 - protein, 15 aa, Homo Sapiens
LISPLMNPVIYSVKT

SEQ ID NO: 8268 - protein, 15 aa, Homo Sapiens
LMNPVIYSVKTKQIR

SEQ ID NO: 8269 - protein, 15 aa, Homo Sapiens
VIYSVKTKQIRRAVI

SEQ ID NO: 8270 - protein, 15 aa, Homo Sapiens
KQIRRAVIKILHSKE

SEQ ID NO: 8271 - protein, 15 aa, Homo Sapiens
PVIYSVKTKQIRRAV

SEQ ID NO: 8272 - protein, 15 aa, Homo Sapiens
LAMAFDRFVAVSNPL

SEQ ID NO: 8273 - protein, 15 aa, Homo Sapiens
AVSNPLRYAMILTDS

SEQ ID NO: 8274 - protein, 15 aa, Homo Sapiens
GVASVIRGLLMLTPM

SEQ ID NO: 8275 - protein, 15 aa, Homo Sapiens
YHPDVMKLSCTDTRI

SEQ ID NO: 8276 - protein, 15 aa, Homo Sapiens
VASPEERKETFSTCV

SEQ ID NO: 8277 - protein, 15 aa, Homo Sapiens
VKTKQIRRAVIKILH

SEQ ID NO: 8278 - protein, 15 aa, Homo Sapiens
KTKQIRRAVIKILHS

SEQ ID NO: 8279 - protein, 15 aa, Homo Sapiens
MILTDSRIAQIGVAS

SEQ ID NO: 8280 - protein, 15 aa, Homo Sapiens
IVHRFGKQAPAYVHT

SEQ ID NO: 8281 - protein, 15 aa, Homo Sapiens
LSIFWFNVREISFNA

SEQ ID NO: 8282 - protein, 15 aa, Homo Sapiens
LLSYVLIIRTVLSVA

SEQ ID NO: 8283 - protein, 15 aa, Homo Sapiens
ETFSTCVSHIVAFAI

SEQ ID NO: 8284 - protein, 15 aa, Homo Sapiens
PLISLSIVHRFGKQA

SEQ ID NO: 8285 - protein, 15 aa, Homo Sapiens
GLSISTLVTMLSIFW

SEQ ID NO: 8286 - protein, 15 aa, Homo Sapiens
QIGVASVIRGLLMLT

SEQ ID NO: 8287 - protein, 15 aa, Homo Sapiens
AVGLTAMFSTVGVDL

SEQ ID NO: 8288 - protein, 15 aa, Homo Sapiens
IKFFTVMESSVLLAM

SEQ ID NO: 8289 - protein, 15 aa, Homo Sapiens
LTPMVALLIRLSYCH

SEQ ID NO: 8290 - protein, 15 aa, Homo Sapiens
TPMVALLIRLSYCHS

SEQ ID NO: 8291 - protein, 15 aa, Homo Sapiens
LISLSIVHRFGKQAP

SEQ ID NO: 8292 - protein, 15 aa, Homo Sapiens
LSIVHRFGKQAPAYV

SEQ ID NO: 8293 - protein, 15 aa, Homo Sapiens
PVIYSVKTKQIRRAV

SEQ ID NO: 8294 - protein, 15 aa, Homo Sapiens
IRGLLMLTPMVALLI

SEQ ID NO: 8295 - protein, 15 aa, Homo Sapiens
SYCYHPDVMKLSCTD

SEQ ID NO: 8296 - protein, 15 aa, Homo Sapiens
TVGVDLLLILLSYVL

SEQ ID NO: 8297 - protein, 15 aa, Homo Sapiens
LSYVLIIRTVLSVAS

SEQ ID NO: 8298 - protein, 15 aa, Homo Sapiens
ASVIRGLLMLTPMVA

SEQ ID NO: 8299 - protein, 15 aa, Homo Sapiens
VALLIRLSYCHSQVL

SEQ ID NO: 8300 - protein, 15 aa, Homo Sapiens
VLIIRTVLSVASPEE

SEQ ID NO: 8301 - protein, 15 aa, Homo Sapiens
SIFWFNVREISFNAC

SEQ ID NO: 8302 - protein, 15 aa, Homo Sapiens
FIKFFTVMESSVLLA

SEQ ID NO: 8303 - protein, 15 aa, Homo Sapiens
FDRFVAVSNPLRYAM

SEQ ID NO: 8304 - protein, 15 aa, Homo Sapiens
LLMLTPMVALLIRLS

SEQ ID NO: 8305 - protein, 15 aa, Homo Sapiens
TAMFSTVGVDLLLIL

SEQ ID NO: 8306 - protein, 15 aa, Homo Sapiens
FAIYYIPLISLSIVH

SEQ ID NO: 8307 - protein, 15 aa, Homo Sapiens
MNPVIYSVKTKQIRR

SEQ ID NO: 8308 - protein, 15 aa, Homo Sapiens
MYYFLSMLSATDLGL

SEQ ID NO: 8309 - protein, 15 aa, Homo Sapiens
PLRYAMILTDSRIAQ

SEQ ID NO: 8310 - protein, 15 aa, Homo Sapiens
AIYYIPLISLSIVHR

SEQ ID NO: 8311 - protein, 15 aa, Homo Sapiens
ANTYLLISPLMNPVI

SEQ ID NO: 8312 - protein, 15 aa, Homo Sapiens
MLSATDLGLSISTLV

SEQ ID NO: 8313 - protein, 15 aa, Homo Sapiens
VLLAMAFDRFVAVSN

SEQ ID NO: 8314 - protein, 15 aa, Homo Sapiens
IAQIGVASVIRGLLM

SEQ ID NO: 8315 - protein, 15 aa, Homo Sapiens
YCHSQVLHHSYCYHP

SEQ ID NO: 8316 - protein, 15 aa, Homo Sapiens
SCTDTRINSAVGLTA

SEQ ID NO: 8317 - protein, 15 aa, Homo Sapiens
YVLIIRTVLSVASPE

SEQ ID NO: 8318 - protein, 15 aa, Homo Sapiens
LIIRTVLSVASPEER

SEQ ID NO: 8319 - protein, 15 aa, Homo Sapiens
IYSVKTKQIRRAVIK

SEQ ID NO: 8320 - protein, 15 aa, Homo Sapiens
SVKTKQIRRAVIKIL

SEQ ID NO: 8321 - protein, 15 aa, Homo Sapiens
KQIRRAVIKILHSKE

SEQ ID NO: 8322 - protein, 15 aa, Homo Sapiens
STLVTMLSIFWFNVR

SEQ ID NO: 8323 - protein, 15 aa, Homo Sapiens
ISFNACLSHMFFIKF

SEQ ID NO: 8324 - protein, 15 aa, Homo Sapiens
SSVLLAMAFDRFVAV

SEQ ID NO: 8325 - protein, 15 aa, Homo Sapiens
FVAVSNPLRYAMILT

SEQ ID NO: 8326 - protein, 15 aa, Homo Sapiens
RYAMILTDSRIAQIG

SEQ ID NO: 8327 - protein, 15 aa, Homo Sapiens
YAMILTDSRIAQIGV

SEQ ID NO: 8328 - protein, 15 aa, Homo Sapiens
SYCHSQVLHHSYCYH

SEQ ID NO: 8329 - protein, 15 aa, Homo Sapiens
YCYHPDVMKLSCTDT

SEQ ID NO: 8330 - protein, 15 aa, Homo Sapiens
MKLSCTDTRINSAVG

SEQ ID NO: 8331 - protein, 15 aa, Homo Sapiens
DTRINSAVGLTAMFS

SEQ ID NO: 8332 - protein, 15 aa, Homo Sapiens
LILLSYVLIIRTVLS

SEQ ID NO: 8333 - protein, 15 aa, Homo Sapiens
STCVSHIVAFAIYYI

SEQ ID NO: 8334 - protein, 15 aa, Homo Sapiens
LSMLSATDLGLSIST

SEQ ID NO: 8335 - protein, 15 aa, Homo Sapiens
NACLSHMFFIKFFTV

SEQ ID NO: 8336 - protein, 15 aa, Homo Sapiens
LSHMFFIKFFTVMES

SEQ ID NO: 8337 - protein, 15 aa, Homo Sapiens
FFTVMESSVLLAMAF

SEQ ID NO: 8338 - protein, 15 aa, Homo Sapiens
VDLLLILLSYVLIIR

SEQ ID NO: 8339 - protein, 15 aa, Homo Sapiens
DLLLILLSYVLIIRT

SEQ ID NO: 8340 - protein, 15 aa, Homo Sapiens
KETFSTCVSHIVAFA

SEQ ID NO: 8341 - protein, 15 aa, Homo Sapiens
SHIVAFAIYYIPLIS

SEQ ID NO: 8342 - protein, 15 aa, Homo Sapiens
IYYIPLISLSIVHRF

SEQ ID NO: 8343 - protein, 15 aa, Homo Sapiens
KQAPAYVHTMIANTY

SEQ ID NO: 8344 - protein, 15 aa, Homo Sapiens
HTMIANTYLLISPLM

SEQ ID NO: 8345 - protein, 15 aa, Homo Sapiens
YLLISPLMNPVIYSV

SEQ ID NO: 8346 - protein, 15 aa, Homo Sapiens
SPLMNPVIYSVKTKQ

SEQ ID NO: 8347 - protein, 15 aa, Homo Sapiens
QIRRAVIKILHSKET

SEQ ID NO: 8348 - protein, 15 aa, Homo Sapiens
YYFLSMLSATDLGLS

SEQ ID NO: 8349 - protein, 15 aa, Homo Sapiens
ISTLVTMLSIFWFNV

SEQ ID NO: 8350 - protein, 15 aa, Homo Sapiens
LVTMLSIFWFNVREI

SEQ ID NO: 8351 - protein, 15 aa, Homo Sapiens
WFNVREISFNACLSH

SEQ ID NO: 8352 - protein, 15 aa, Homo Sapiens
SHMFFIKFFTVMESS

SEQ ID NO: 8353 - protein, 15 aa, Homo Sapiens
MFFIKFFTVMESSVL

SEQ ID NO: 8354 - protein, 15 aa, Homo Sapiens
TVMESSVLLAMAFDR

SEQ ID NO: 8355 - protein, 15 aa, Homo Sapiens
AMAFDRFVAVSNPLR

SEQ ID NO: 8356 - protein, 15 aa, Homo Sapiens
MAFDRFVAVSNPLRY

SEQ ID NO: 8357 - protein, 15 aa, Homo Sapiens
NPLRYAMILTDSRIA

SEQ ID NO: 8358 - protein, 15 aa, Homo Sapiens
DSRIAQIGVASVIRG

SEQ ID NO: 8359 - protein, 15 aa, Homo Sapiens
SQVLHHSYCYHPDVM

SEQ ID NO: 8360 - protein, 15 aa, Homo Sapiens
HPDVMKLSCTDTRIN

SEQ ID NO: 8361 - protein, 15 aa, Homo Sapiens
INSAVGLTAMFSTVG

SEQ ID NO: 8362 - protein, 15 aa, Homo Sapiens
GVDLLLILLSYVLII

SEQ ID NO: 8363 - protein, 15 aa, Homo Sapiens
IRTVLSVASPEERKE

SEQ ID NO: 8364 - protein, 15 aa, Homo Sapiens
AFAIYYIPLISLSIV

SEQ ID NO: 8365 - protein, 15 aa, Homo Sapiens
YIPLISLSIVHRFGK

SEQ ID NO: 8366 - protein, 15 aa, Homo Sapiens
SLSIVHRFGKQAPAY

SEQ ID NO: 8367 - protein, 15 aa, Homo Sapiens
PAYVHTMIANTYLLI

SEQ ID NO: 8368 - protein, 15 aa, Homo Sapiens
NTYLLISPLMNPVIY

SEQ ID NO: 8369 - protein, 15 aa, Homo Sapiens
NPVIYSVKTKQIRRA

SEQ ID NO: 8370 - protein, 15 aa, Homo Sapiens
IFWFNVREISFNACL

SEQ ID NO: 8371 - protein, 15 aa, Homo Sapiens
IVAFAIYYIPLISLS

SEQ ID NO: 8372 - protein, 15 aa, Homo Sapiens
YSVKTKQIRRAVIKI

SEQ ID NO: 8373 - protein, 15 aa, Homo Sapiens
EISFNACLSHMFFIK

SEQ ID NO: 8374 - protein, 15 aa, Homo Sapiens
HMFFIKFFTVMESSV

SEQ ID NO: 8375 - protein, 15 aa, Homo Sapiens
RLSYCHSQVLHHSYC

SEQ ID NO: 8376 - protein, 15 aa, Homo Sapiens
HHSYCYHPDVMKLSC

SEQ ID NO: 8377 - protein, 15 aa, Homo Sapiens
VHRFGKQAPAYVHTM

SEQ ID NO: 8378 - protein, 15 aa, Homo Sapiens
GKQAPAYVHTMIANT

SEQ ID NO: 8379 - protein, 15 aa, Homo Sapiens
APAYVHTMIANTYLL

SEQ ID NO: 8380 - protein, 15 aa, Homo Sapiens
FFIKFFTVMESSVLL

SEQ ID NO: 8381 - protein, 15 aa, Homo Sapiens
DRFVAVSNPLRYAMI

SEQ ID NO: 8382 - protein, 15 aa, Homo Sapiens
LTAMFSTVGVDLLLI

SEQ ID NO: 8383 - protein, 15 aa, Homo Sapiens
LLILLSYVLIIRTVL

SEQ ID NO: 8384 - protein, 15 aa, Homo Sapiens
TKQIRRAVIKILHSK

SEQ ID NO: 8385 - protein, 15 aa, Homo Sapiens
LSISTLVTMLSIFWF

SEQ ID NO: 8386 - protein, 15 aa, Homo Sapiens
MLSIFWFNVREISFN

SEQ ID NO: 8387 - protein, 15 aa, Homo Sapiens
CLSHMFFIKFFTVME

SEQ ID NO: 8388 - protein, 15 aa, Homo Sapiens
FTVMESSVLLAMAFD

SEQ ID NO: 8389 - protein, 15 aa, Homo Sapiens
LAMAFDRFVAVSNPL

SEQ ID NO: 8390 - protein, 15 aa, Homo Sapiens
LRYAMILTDSRIAQI

SEQ ID NO: 8391 - protein, 15 aa, Homo Sapiens
AMILTDSRIAQIGVA

SEQ ID NO: 8392 - protein, 15 aa, Homo Sapiens
IGVASVIRGLLMLTP

SEQ ID NO: 8393 - protein, 15 aa, Homo Sapiens
LLIRLSYCHSQVLHH

SEQ ID NO: 8394 - protein, 15 aa, Homo Sapiens
LSYCHSQVLHHSYCY

SEQ ID NO: 8395 - protein, 15 aa, Homo Sapiens
VLHHSYCYHPDVMKL

SEQ ID NO: 8396 - protein, 15 aa, Homo Sapiens
VMKLSCTDTRINSAV

SEQ ID NO: 8397 - protein, 15 aa, Homo Sapiens
KLSCTDTRINSAVGL

SEQ ID NO: 8398 - protein, 15 aa, Homo Sapiens
FSTVGVDLLLILLSY

SEQ ID NO: 8399 - protein, 15 aa, Homo Sapiens
ILLSYVLIIRTVLSV

SEQ ID NO: 8400 - protein, 15 aa, Homo Sapiens
VLSVASPEERKETFS

SEQ ID NO: 8401 - protein, 15 aa, Homo Sapiens
LSVASPEERKETFST

SEQ ID NO: 8402 - protein, 15 aa, Homo Sapiens
SVASPEERKETFSTC

SEQ ID NO: 8403 - protein, 15 aa, Homo Sapiens
IPLISLSIVHRFGKQ

SEQ ID NO: 8404 - protein, 15 aa, Homo Sapiens
AYVHTMIANTYLLIS

SEQ ID NO: 8405 - protein, 15 aa, Homo Sapiens
MIANTYLLISPLMNP

SEQ ID NO: 8406 - protein, 15 aa, Homo Sapiens
ISPLMNPVIYSVKTK

SEQ ID NO: 8407 - protein, 15 aa, Homo Sapiens
PLMNPVIYSVKTKQI

SEQ ID NO: 8408 - protein, 15 aa, Homo Sapiens
YFLSMLSATDLGLSI

SEQ ID NO: 8409 - protein, 15 aa, Homo Sapiens
ATDLGLSISTLVTML

SEQ ID NO: 8410 - protein, 15 aa, Homo Sapiens
TDLGLSISTLVTMLS

SEQ ID NO: 8411 - protein, 15 aa, Homo Sapiens
VTMLSIFWFNVREIS

SEQ ID NO: 8412 - protein, 15 aa, Homo Sapiens
NVREISFNACLSHMF

SEQ ID NO: 8413 - protein, 15 aa, Homo Sapiens
VMESSVLLAMAFDRF

SEQ ID NO: 8414 - protein, 15 aa, Homo Sapiens
SVLLAMAFDRFVAVS

SEQ ID NO: 8415 - protein, 15 aa, Homo Sapiens
RFVAVSNPLRYAMIL

SEQ ID NO: 8416 - protein, 15 aa, Homo Sapiens
MILTDSRIAQIGVAS

SEQ ID NO: 8417 - protein, 15 aa, Homo Sapiens
LTDSRIAQIGVASVI

SEQ ID NO: 8418 - protein, 15 aa, Homo Sapiens
RIAQIGVASVIRGLL

SEQ ID NO: 8419 - protein, 15 aa, Homo Sapiens
VASVIRGLLMLTPMV

SEQ ID NO: 8420 - protein, 15 aa, Homo Sapiens
GLLMLTPMVALLIRL

SEQ ID NO: 8421 - protein, 15 aa, Homo Sapiens
LMLTPMVALLIRLSY

SEQ ID NO: 8422 - protein, 15 aa, Homo Sapiens
LIRLSYCHSQVLHHS

SEQ ID NO: 8423 - protein, 15 aa, Homo Sapiens
CYHPDVMKLSCTDTR

SEQ ID NO: 8424 - protein, 15 aa, Homo Sapiens
MFSTVGVDLLLILLS

SEQ ID NO: 8425 - protein, 15 aa, Homo Sapiens
STVGVDLLLILLSYV

SEQ ID NO: 8426 - protein, 15 aa, Homo Sapiens
LLLILLSYVLIIRTV

SEQ ID NO: 8427 - protein, 15 aa, Homo Sapiens
RTVLSVASPEERKET

SEQ ID NO: 8428 - protein, 15 aa, Homo Sapiens
EERKETFSTCVSHIV

SEQ ID NO: 8429 - protein, 15 aa, Homo Sapiens
TCVSHIVAFAIYYIP

SEQ ID NO: 8430 - protein, 15 aa, Homo Sapiens
HIVAFAIYYIPLISL

SEQ ID NO: 8431 - protein, 15 aa, Homo Sapiens
VAFAIYYIPLISLSI

SEQ ID NO: 8432 - protein, 15 aa, Homo Sapiens
VHTMIANTYLLISPL

SEQ ID NO: 8433 - protein, 15 aa, Homo Sapiens
IANTYLLISPLMNPV

SEQ ID NO: 8434 - protein, 15 aa, Homo Sapiens
LLISPLMNPVIYSVK

SEQ ID NO: 8435 - protein, 15 aa, Homo Sapiens
FLSMLSATDLGLSIS

SEQ ID NO: 8436 - protein, 15 aa, Homo Sapiens
SATDLGLSISTLVTM

SEQ ID NO: 8437 - protein, 15 aa, Homo Sapiens
DLGLSISTLVTMLSI

SEQ ID NO: 8438 - protein, 15 aa, Homo Sapiens
FWFNVREISFNACLS

SEQ ID NO: 8439 - protein, 15 aa, Homo Sapiens
VREISFNACLSHMFF

SEQ ID NO: 8440 - protein, 15 aa, Homo Sapiens
MESSVLLAMAFDRFV

SEQ ID NO: 8441 - protein, 15 aa, Homo Sapiens
ESSVLLAMAFDRFVA

SEQ ID NO: 8442 - protein, 15 aa, Homo Sapiens
LLAMAFDRFVAVSNP

SEQ ID NO: 8443 - protein, 15 aa, Homo Sapiens
VAVSNPLRYAMILTD

SEQ ID NO: 8444 - protein, 15 aa, Homo Sapiens
SNPLRYAMILTDSRI

SEQ ID NO: 8445 - protein, 15 aa, Homo Sapiens
ILTDSRIAQIGVASV

SEQ ID NO: 8446 - protein, 15 aa, Homo Sapiens
TDSRIAQIGVASVIR

SEQ ID NO: 8447 - protein, 15 aa, Homo Sapiens
SVIRGLLMLTPMVAL

SEQ ID NO: 8448 - protein, 15 aa, Homo Sapiens
VIRGLLMLTPMVALL

SEQ ID NO: 8449 - protein, 15 aa, Homo Sapiens
RGLLMLTPMVALLIR

SEQ ID NO: 8450 - protein, 15 aa, Homo Sapiens
PMVALLIRLSYCHSQ

SEQ ID NO: 8451 - protein, 15 aa, Homo Sapiens
MVALLIRLSYCHSQV

SEQ ID NO: 8452 - protein, 15 aa, Homo Sapiens
ALLIRLSYCHSQVLH

SEQ ID NO: 8453 - protein, 15 aa, Homo Sapiens
HSQVLHHSYCYHPDV

SEQ ID NO: 8454 - protein, 15 aa, Homo Sapiens
PDVMKLSCTDTRINS

SEQ ID NO: 8455 - protein, 15 aa, Homo Sapiens
TRINSAVGLTAMFST

SEQ ID NO: 8456 - protein, 15 aa, Homo Sapiens
NSAVGLTAMFSTVGV

SEQ ID NO: 8457 - protein, 15 aa, Homo Sapiens
AMFSTVGVDLLLILL

SEQ ID NO: 8458 - protein, 15 aa, Homo Sapiens
VGVDLLLILLSYVLI

SEQ ID NO: 8459 - protein, 15 aa, Homo Sapiens
SYVLIIRTVLSVASP

SEQ ID NO: 8460 - protein, 15 aa, Homo Sapiens
VASPEERKETFSTCV

SEQ ID NO: 8461 - protein, 15 aa, Homo Sapiens
FSTCVSHIVAFAIYY

SEQ ID NO: 8462 - protein, 15 aa, Homo Sapiens
VSHIVAFAIYYIPLI

SEQ ID NO: 8463 - protein, 15 aa, Homo Sapiens
SIVHRFGKQAPAYVH

SEQ ID NO: 8464 - protein, 15 aa, Homo Sapiens
TMIANTYLLISPLMN

SEQ ID NO: 8465 - protein, 15 aa, Homo Sapiens
TYLLISPLMNPVIYS

SEQ ID NO: 8466 - protein, 15 aa, Homo Sapiens
LISPLMNPVIYSVKT

SEQ ID NO: 8467 - protein, 15 aa, Homo Sapiens
AFDRFVAVSNPLRYA

SEQ ID NO: 8468 - protein, 15 aa, Homo Sapiens
SRIAQIGVASVIRGL

SEQ ID NO: 8469 - protein, 15 aa, Homo Sapiens
AQIGVASVIRGLLML

SEQ ID NO: 8470 - protein, 15 aa, Homo Sapiens
MLTPMVALLIRLSYC

SEQ ID NO: 8471 - protein, 15 aa, Homo Sapiens
SISTLVTMLSIFWFN

SEQ ID NO: 8472 - protein, 15 aa, Homo Sapiens
TMLSIFWFNVREISF

SEQ ID NO: 8473 - protein, 15 aa, Homo Sapiens
DVMKLSCTDTRINSA

SEQ ID NO: 8474 - protein, 15 aa, Homo Sapiens
IIRTVLSVASPEERK

SEQ ID NO: 8475 - protein, 15 aa, Homo Sapiens
TVLSVASPEERKETF

SEQ ID NO: 8476 - protein, 15 aa, Homo Sapiens
ERKETFSTCVSHIVA

SEQ ID NO: 8477 - protein, 15 aa, Homo Sapiens
ISLSIVHRFGKQAPA

SEQ ID NO: 8478 - protein, 15 aa, Homo Sapiens
VIYSVKTKQIRRAVI

SEQ ID NO: 8479 - protein, 15 aa, Homo Sapiens
REISFNACLSHMFFI

SEQ ID NO: 8480 - protein, 15 aa, Homo Sapiens
FNACLSHMFFIKFFT

SEQ ID NO: 8481 - protein, 15 aa, Homo Sapiens
KFFTVMESSVLLAMA

SEQ ID NO: 8482 - protein, 15 aa, Homo Sapiens
AVSNPLRYAMILTDS

SEQ ID NO: 8483 - protein, 15 aa, Homo Sapiens
VSNPLRYAMILTDSR

SEQ ID NO: 8484 - protein, 15 aa, Homo Sapiens
IRLSYCHSQVLHHSY

SEQ ID NO: 8485 - protein, 15 aa, Homo Sapiens
LHHSYCYHPDVMKLS

SEQ ID NO: 8486 - protein, 15 aa, Homo Sapiens
HSYCYHPDVMKLSCT

SEQ ID NO: 8487 - protein, 15 aa, Homo Sapiens
TDTRINSAVGLTAMF

SEQ ID NO: 8488 - protein, 15 aa, Homo Sapiens
RINSAVGLTAMFSTV

SEQ ID NO: 8489 - protein, 15 aa, Homo Sapiens
GLTAMFSTVGVDLLL

SEQ ID NO: 8490 - protein, 15 aa, Homo Sapiens
RKETFSTCVSHIVAF

SEQ ID NO: 8491 - protein, 15 aa, Homo Sapiens
TFSTCVSHIVAFAIY

SEQ ID NO: 8492 - protein, 15 aa, Homo Sapiens
CVSHIVAFAIYYIPL

SEQ ID NO: 8493 - protein, 15 aa, Homo Sapiens
YYIPLISLSIVHRFG

SEQ ID NO: 8494 - protein, 15 aa, Homo Sapiens
IVHRFGPQAPAYVHT

SEQ ID NO: 8495 - protein, 15 aa, Homo Sapiens
ITSTLQNITSTSIIF

SEQ ID NO: 8496 - protein, 15 aa, Homo Sapiens
IFLLTGVPGLEAFHT

SEQ ID NO: 8497 - protein, 15 aa, Homo Sapiens
LILFATITQPSLHEP

SEQ ID NO: 8498 - protein, 15 aa, Homo Sapiens
TITQPSLHEPMYYFL

SEQ ID NO: 8499 - protein, 15 aa, Homo Sapiens
EPMYYFLSMLSATDL

SEQ ID NO: 8500 - protein, 15 aa, Homo Sapiens
LLGNSLILFATITQP

SEQ ID NO: 8501 - protein, 15 aa, Homo Sapiens
TSIIFLLTGVPGLEA

SEQ ID NO: 8502 - protein, 15 aa, Homo Sapiens
VPGLEAFHTWISIPF

SEQ ID NO: 8503 - protein, 15 aa, Homo Sapiens
SLILFATITQPSLHE

SEQ ID NO: 8504 - protein, 15 aa, Homo Sapiens
NITSTSIIFLLTGVP

SEQ ID NO: 8505 - protein, 15 aa, Homo Sapiens
ITSTSIIFLLTGVPG

SEQ ID NO: 8506 - protein, 15 aa, Homo Sapiens
STSIIFLLTGVPGLE

SEQ ID NO: 8507 - protein, 15 aa, Homo Sapiens
LLTGVPGLEAFHTWI

SEQ ID NO: 8508 - protein, 15 aa, Homo Sapiens
LTGVPGLEAFHTWIS

SEQ ID NO: 8509 - protein, 15 aa, Homo Sapiens
HTWISIPFCFLSVTA

SEQ ID NO: 8510 - protein, 15 aa, Homo Sapiens
ISIPFCFLSVTALLG

SEQ ID NO: 8511 - protein, 15 aa, Homo Sapiens
PFCFLSVTALLGNSL

SEQ ID NO: 8512 - protein, 15 aa, Homo Sapiens
CFLSVTALLGNSLIL

SEQ ID NO: 8513 - protein, 15 aa, Homo Sapiens
FLSVTALLGNSLILF

SEQ ID NO: 8514 - protein, 15 aa, Homo Sapiens
TALLGNSLILFATIT

SEQ ID NO: 8515 - protein, 15 aa, Homo Sapiens
ALLGNSLILFATITQ

SEQ ID NO: 8516 - protein, 15 aa, Homo Sapiens
LGNSLILFATITQPS

SEQ ID NO: 8517 - protein, 15 aa, Homo Sapiens
PSLHEPMYYFLSMLS

SEQ ID NO: 8518 - protein, 15 aa, Homo Sapiens
HEPMYYFLSMLSATD

SEQ ID NO: 8519 - protein, 15 aa, Homo Sapiens
TSTLQNITSTSIIFL

SEQ ID NO: 8520 - protein, 15 aa, Homo Sapiens
TLQNITSTSIIFLLT

SEQ ID NO: 8521 - protein, 15 aa, Homo Sapiens
EAFHTWISIPFCFLS

SEQ ID NO: 8522 - protein, 15 aa, Homo Sapiens
FHTWISIPFCFLSVT

SEQ ID NO: 8523 - protein, 15 aa, Homo Sapiens
SIPFCFLSVTALLGN

SEQ ID NO: 8524 - protein, 15 aa, Homo Sapiens
LSVTALLGNSLILFA

SEQ ID NO: 8525 - protein, 15 aa, Homo Sapiens
VTALLGNSLILFATI

SEQ ID NO: 8526 - protein, 15 aa, Homo Sapiens
GNSLILFATITQPSL

SEQ ID NO: 8527 - protein, 15 aa, Homo Sapiens
FITSTLQNITSTSII

SEQ ID NO: 8528 - protein, 15 aa, Homo Sapiens
STLQNITSTSIIFLL

SEQ ID NO: 8529 - protein, 15 aa, Homo Sapiens
WISIPFCFLSVTALL

SEQ ID NO: 8530 - protein, 15 aa, Homo Sapiens
IPFCFLSVTALLGNS

SEQ ID NO: 8531 - protein, 15 aa, Homo Sapiens
PMYYFLSMLSATDLG

SEQ ID NO: 8532 - protein, 15 aa, Homo Sapiens
TSIIFLLTGVPGLEA

SEQ ID NO: 8533 - protein, 15 aa, Homo Sapiens
IFLLTGVPGLEAFHT

SEQ ID NO: 8534 - protein, 15 aa, Homo Sapiens
LTGVPGLEAFHTWIS

SEQ ID NO: 8535 - protein, 15 aa, Homo Sapiens
FLSVTALLGNSLILF

SEQ ID NO: 8536 - protein, 15 aa, Homo Sapiens
TSTLQNITSTSIIFL

SEQ ID NO: 8537 - protein, 15 aa, Homo Sapiens
STSIIFLLTGVPGLE

SEQ ID NO: 8538 - protein, 15 aa, Homo Sapiens
VPGLEAFHTWISIPF

SEQ ID NO: 8539 - protein, 15 aa, Homo Sapiens
PFCFLSVTALLGNSL

SEQ ID NO: 8540 - protein, 15 aa, Homo Sapiens
TALLGNSLILFATIT

SEQ ID NO: 8541 - protein, 15 aa, Homo Sapiens
GNSLILFATITQPSL

SEQ ID NO: 8542 - protein, 15 aa, Homo Sapiens
LILFATITQPSLHEP

SEQ ID NO: 8543 - protein, 15 aa, Homo Sapiens
FHTWISIPFCFLSVT

SEQ ID NO: 8544 - protein, 15 aa, Homo Sapiens
SIPFCFLSVTALLGN

SEQ ID NO: 8545 - protein, 15 aa, Homo Sapiens
EPMYYFLSMLSATDL

SEQ ID NO: 8546 - protein, 15 aa, Homo Sapiens
PMYYFLSMLSATDLG

SEQ ID NO: 8547 - protein, 15 aa, Homo Sapiens
LQNITSTSIIFLLTG

SEQ ID NO: 8548 - protein, 15 aa, Homo Sapiens
IIFLLTGVPGLEAFH

SEQ ID NO: 8549 - protein, 15 aa, Homo Sapiens
HTWISIPFCFLSVTA

SEQ ID NO: 8550 - protein, 15 aa, Homo Sapiens
WISIPFCFLSVTALL

SEQ ID NO: 8551 - protein, 15 aa, Homo Sapiens
FCFLSVTALLGNSLI

SEQ ID NO: 8552 - protein, 15 aa, Homo Sapiens
LSVTALLGNSLILFA

SEQ ID NO: 8553 - protein, 15 aa, Homo Sapiens
VTALLGNSLILFATI

SEQ ID NO: 8554 - protein, 15 aa, Homo Sapiens
LGNSLILFATITQPS

SEQ ID NO: 8555 - protein, 15 aa, Homo Sapiens
NSLILFATITQPSLH

SEQ ID NO: 8556 - protein, 15 aa, Homo Sapiens
SLILFATITQPSLHE

SEQ ID NO: 8557 - protein, 15 aa, Homo Sapiens
FATITQPSLHEPMYY

SEQ ID NO: 8558 - protein, 15 aa, Homo Sapiens
TITQPSLHEPMYYFL

SEQ ID NO: 8559 - protein, 15 aa, Homo Sapiens
QPSLHEPMYYFLSML

SEQ ID NO: 8560 - protein, 15 aa, Homo Sapiens
TLQNITSTSIIFLLT

SEQ ID NO: 8561 - protein, 15 aa, Homo Sapiens
QNITSTSIIFLLTGV

SEQ ID NO: 8562 - protein, 15 aa, Homo Sapiens
NITSTSIIFLLTGVP

SEQ ID NO: 8563 - protein, 15 aa, Homo Sapiens
ITSTSIIFLLTGVPG

SEQ ID NO: 8564 - protein, 15 aa, Homo Sapiens
TSTSIIFLLTGVPGL

SEQ ID NO: 8565 - protein, 15 aa, Homo Sapiens
SIIFLLTGVPGLEAF

SEQ ID NO: 8566 - protein, 15 aa, Homo Sapiens
LEAFHTWISIPFCFL

SEQ ID NO: 8567 - protein, 15 aa, Homo Sapiens
EAFHTWISIPFCFLS

SEQ ID NO: 8568 - protein, 15 aa, Homo Sapiens
AFHTWISIPFCFLSV

SEQ ID NO: 8569 - protein, 15 aa, Homo Sapiens
TWISIPFCFLSVTAL

SEQ ID NO: 8570 - protein, 15 aa, Homo Sapiens
ISIPFCFLSVTALLG

SEQ ID NO: 8571 - protein, 15 aa, Homo Sapiens
IPFCFLSVTALLGNS

SEQ ID NO: 8572 - protein, 15 aa, Homo Sapiens
ALLGNSLILFATITQ

SEQ ID NO: 8573 - protein, 15 aa, Homo Sapiens
LLGNSLILFATITQP

SEQ ID NO: 8574 - protein, 15 aa, Homo Sapiens
ATITQPSLHEPMYYF

SEQ ID NO: 8575 - protein, 15 aa, Homo Sapiens
HEPMYYFLSMLSATD

SEQ ID NO: 8576 - protein, 15 aa, Homo Sapiens
LLTGVPGLEAFHTWI

SEQ ID NO: 8577 - protein, 15 aa, Homo Sapiens
FLSVTALLGNSLILF

SEQ ID NO: 8578 - protein, 15 aa, Homo Sapiens
STSIIFLLTGVPGLE

SEQ ID NO: 8579 - protein, 15 aa, Homo Sapiens
IFLLTGVPGLEAFHT

SEQ ID NO: 8580 - protein, 15 aa, Homo Sapiens
TSTLQNITSTSIIFL

SEQ ID NO: 8581 - protein, 15 aa, Homo Sapiens
SIPFCFLSVTALLGN

SEQ ID NO: 8582 - protein, 15 aa, Homo Sapiens
EPMYYFLSMLSATDL

SEQ ID NO: 8583 - protein, 15 aa, Homo Sapiens
TSIIFLLTGVPGLEA

SEQ ID NO: 8584 - protein, 15 aa, Homo Sapiens
LTGVPGLEAFHTWIS

SEQ ID NO: 8585 - protein, 15 aa, Homo Sapiens
LEAFHTWISIPFCFL

SEQ ID NO: 8586 - protein, 15 aa, Homo Sapiens
FHTWISIPFCFLSVT

SEQ ID NO: 8587 - protein, 15 aa, Homo Sapiens
PFCFLSVTALLGNSL

SEQ ID NO: 8588 - protein, 15 aa, Homo Sapiens
LILFATITQPSLHEP

SEQ ID NO: 8589 - protein, 15 aa, Homo Sapiens
SIIFLLTGVPGLEAF

SEQ ID NO: 8590 - protein, 15 aa, Homo Sapiens
VPGLEAFHTWISIPF

SEQ ID NO: 8591 - protein, 15 aa, Homo Sapiens
SLILFATITQPSLHE

SEQ ID NO: 8592 - protein, 15 aa, Homo Sapiens
HEPMYYFLSMLSATD

SEQ ID NO: 8593 - protein, 15 aa, Homo Sapiens
LGNSLILFATITQPS

SEQ ID NO: 8594 - protein, 15 aa, Homo Sapiens
HTWISIPFCFLSVTA

SEQ ID NO: 8595 - protein, 15 aa, Homo Sapiens
STLQNITSTSIIFLL

SEQ ID NO: 8596 - protein, 15 aa, Homo Sapiens
LSVTALLGNSLILFA

SEQ ID NO: 8597 - protein, 15 aa, Homo Sapiens
NSLILFATITQPSLH

SEQ ID NO: 8598 - protein, 15 aa, Homo Sapiens
LQNITSTSIIFLLTG

SEQ ID NO: 8599 - protein, 15 aa, Homo Sapiens
AFHTWISIPFCFLSV

SEQ ID NO: 8600 - protein, 15 aa, Homo Sapiens
FATITQPSLHEPMYY

SEQ ID NO: 8601 - protein, 15 aa, Homo Sapiens
VTALLGNSLILFATI

SEQ ID NO: 8602 - protein, 15 aa, Homo Sapiens
TALLGNSLILFATIT

SEQ ID NO: 8603 - protein, 15 aa, Homo Sapiens
QPSLHEPMYYFLSML

SEQ ID NO: 8604 - protein, 15 aa, Homo Sapiens
IPFCFLSVTALLGNS

SEQ ID NO: 8605 - protein, 15 aa, Homo Sapiens
SVTALLGNSLILFAT

SEQ ID NO: 8606 - protein, 15 aa, Homo Sapiens
LLGNSLILFATITQP

SEQ ID NO: 8607 - protein, 15 aa, Homo Sapiens
GNSLILFATITQPSL

SEQ ID NO: 8608 - protein, 15 aa, Homo Sapiens
ITSTLQNITSTSIIF

SEQ ID NO: 8609 - protein, 15 aa, Homo Sapiens
TLQNITSTSIIFLLT

SEQ ID NO: 8610 - protein, 15 aa, Homo Sapiens
TSTSIIFLLTGVPGL

SEQ ID NO: 8611 - protein, 15 aa, Homo Sapiens
IIFLLTGVPGLEAFH

SEQ ID NO: 8612 - protein, 15 aa, Homo Sapiens
ISIPFCFLSVTALLG

SEQ ID NO: 8613 - protein, 15 aa, Homo Sapiens
PSLHEPMYYFLSMLS

SEQ ID NO: 8614 - protein, 15 aa, Homo Sapiens
LFATITQPSLHEPMY

SEQ ID NO: 8615 - protein, 15 aa, Homo Sapiens
PMYYFLSMLSATDLG

SEQ ID NO: 8616 - protein, 15 aa, Homo Sapiens
FCFLSVTALLGNSLI

SEQ ID NO: 8617 - protein, 15 aa, Homo Sapiens
ILFATITQPSLHEPM

SEQ ID NO: 8618 - protein, 15 aa, Homo Sapiens
FITSTLQNITSTSII

SEQ ID NO: 8619 - protein, 15 aa, Homo Sapiens
ITSTSIIFLLTGVPG

SEQ ID NO: 8620 - protein, 15 aa, Homo Sapiens
FLLTGVPGLEAFHTW

SEQ ID NO: 8621 - protein, 15 aa, Homo Sapiens
GVPGLEAFHTWISIP

SEQ ID NO: 8622 - protein, 15 aa, Homo Sapiens
PGLEAFHTWISIPFC

SEQ ID NO: 8623 - protein, 15 aa, Homo Sapiens
WISIPFCFLSVTALL

SEQ ID NO: 8624 - protein, 15 aa, Homo Sapiens
CFLSVTALLGNSLIL

SEQ ID NO: 8625 - protein, 15 aa, Homo Sapiens
ALLGNSLILFATITQ

SEQ ID NO: 8626 - protein, 15 aa, Homo Sapiens
SLHEPMYYFLSMLSA

SEQ ID NO: 8627 - protein, 15 aa, Homo Sapiens
QNITSTSIIFLLTGV

SEQ ID NO: 8628 - protein, 15 aa, Homo Sapiens
GLEAFHTWISIPFCF

SEQ ID NO: 8629 - protein, 15 aa, Homo Sapiens
TWISIPFCFLSVTAL

SEQ ID NO: 8630 - protein, 15 aa, Homo Sapiens
ATITQPSLHEPMYYF

SEQ ID NO: 8631 - protein, 15 aa, Homo Sapiens
TITQPSLHEPMYYFL

SEQ ID NO: 8632 - protein, 15 aa, Homo Sapiens
ITQPSLHEPMYYFLS

SEQ ID NO: 8633 - protein, 15 aa, Homo Sapiens
TQPSLHEPMYYFLSM

SEQ ID NO: 8634 - protein, 15 aa, Homo Sapiens
LHEPMYYFLSMLSAT

SEQ ID NO: 8635 - protein, 15 aa, Homo Sapiens
NITSTSIIFLLTGVP

SEQ ID NO: 8636 - protein, 15 aa, Homo Sapiens
EAFHTWISIPFCFLS

SEQ ID NO: 8637 - protein, 15 aa, Homo Sapiens
LLTGVPGLEAFHTWI

SEQ ID NO: 8638 - protein, 15 aa, Homo Sapiens
TGVPGLEAFHTWISI

SEQ ID NO: 8639 - protein, 15 aa, Homo Sapiens
VTALLGNSLILFATI

SEQ ID NO: 8640 - protein, 15 aa, Homo Sapiens
LILFATITQPSLHEP

SEQ ID NO: 8641 - protein, 15 aa, Homo Sapiens
LQNITSTSIIFLLTG

SEQ ID NO: 8642 - protein, 15 aa, Homo Sapiens
FLSVTALLGNSLILF

SEQ ID NO: 8643 - protein, 15 aa, Homo Sapiens
SIIFLLTGVPGLEAF

SEQ ID NO: 8644 - protein, 15 aa, Homo Sapiens
QPSLHEPMYYFLSML

SEQ ID NO: 8645 - protein, 15 aa, Homo Sapiens
SIPFCFLSVTALLGN

SEQ ID NO: 8646 - protein, 15 aa, Homo Sapiens
LEAFHTWISIPFCFL

SEQ ID NO: 8647 - protein, 15 aa, Homo Sapiens
TITQPSLHEPMYYFL

SEQ ID NO: 8648 - protein, 15 aa, Homo Sapiens
IIFLLTGVPGLEAFH

SEQ ID NO: 8649 - protein, 15 aa, Homo Sapiens
IFLLTGVPGLEAFHT

SEQ ID NO: 8650 - protein, 15 aa, Homo Sapiens
PFCFLSVTALLGNSL

SEQ ID NO: 8651 - protein, 15 aa, Homo Sapiens
STSIIFLLTGVPGLE

SEQ ID NO: 8652 - protein, 15 aa, Homo Sapiens
TSIIFLLTGVPGLEA

SEQ ID NO: 8653 - protein, 15 aa, Homo Sapiens
SVTALLGNSLILFAT

SEQ ID NO: 8654 - protein, 15 aa, Homo Sapiens
TALLGNSLILFATIT

SEQ ID NO: 8655 - protein, 15 aa, Homo Sapiens
GNSLILFATITQPSL

SEQ ID NO: 8656 - protein, 15 aa, Homo Sapiens
NSLILFATITQPSLH

SEQ ID NO: 8657 - protein, 15 aa, Homo Sapiens
FATITQPSLHEPMYY

SEQ ID NO: 8658 - protein, 15 aa, Homo Sapiens
HEPMYYFLSMLSATD

SEQ ID NO: 8659 - protein, 15 aa, Homo Sapiens
LTGVPGLEAFHTWIS

SEQ ID NO: 8660 - protein, 15 aa, Homo Sapiens
FHTWISIPFCFLSVT

SEQ ID NO: 8661 - protein, 15 aa, Homo Sapiens
HTWISIPFCFLSVTA

SEQ ID NO: 8662 - protein, 15 aa, Homo Sapiens
IPFCFLSVTALLGNS

SEQ ID NO: 8663 - protein, 15 aa, Homo Sapiens
FCFLSVTALLGNSLI

SEQ ID NO: 8664 - protein, 15 aa, Homo Sapiens
SLILFATITQPSLHE

SEQ ID NO: 8665 - protein, 15 aa, Homo Sapiens
TQPSLHEPMYYFLSM

SEQ ID NO: 8666 - protein, 15 aa, Homo Sapiens
TSTLQNITSTSIIFL

SEQ ID NO: 8667 - protein, 15 aa, Homo Sapiens
FLLTGVPGLEAFHTW

SEQ ID NO: 8668 - protein, 15 aa, Homo Sapiens
LLTGVPGLEAFHTWI

SEQ ID NO: 8669 - protein, 15 aa, Homo Sapiens
VPGLEAFHTWISIPF

SEQ ID NO: 8670 - protein, 15 aa, Homo Sapiens
WISIPFCFLSVTALL

SEQ ID NO: 8671 - protein, 15 aa, Homo Sapiens
ITQPSLHEPMYYFLS

SEQ ID NO: 8672 - protein, 15 aa, Homo Sapiens
TLQNITSTSIIFLLT

SEQ ID NO: 8673 - protein, 15 aa, Homo Sapiens
QNITSTSIIFLLTGV

SEQ ID NO: 8674 - protein, 15 aa, Homo Sapiens
LSVTALLGNSLILFA

SEQ ID NO: 8675 - protein, 15 aa, Homo Sapiens
AFHTWISIPFCFLSV

SEQ ID NO: 8676 - protein, 15 aa, Homo Sapiens
LHEPMYYFLSMLSAT

SEQ ID NO: 8677 - protein, 15 aa, Homo Sapiens
NITSTSIIFLLTGVP

SEQ ID NO: 8678 - protein, 15 aa, Homo Sapiens
GVPGLEAFHTWISIP

SEQ ID NO: 8679 - protein, 15 aa, Homo Sapiens
TWISIPFCFLSVTAL

SEQ ID NO: 8680 - protein, 15 aa, Homo Sapiens
CFLSVTALLGNSLIL

SEQ ID NO: 8681 - protein, 15 aa, Homo Sapiens
LLGNSLILFATITQP

SEQ ID NO: 8682 - protein, 15 aa, Homo Sapiens
LFATITQPSLHEPMY

SEQ ID NO: 8683 - protein, 15 aa, Homo Sapiens
FITSTLQNITSTSII

SEQ ID NO: 8684 - protein, 15 aa, Homo Sapiens
ITSTLQNITSTSIIF

SEQ ID NO: 8685 - protein, 15 aa, Homo Sapiens
TSTSIIFLLTGVPGL

SEQ ID NO: 8686 - protein, 15 aa, Homo Sapiens
EAFHTWISIPFCFLS

SEQ ID NO: 8687 - protein, 15 aa, Homo Sapiens
ISIPFCFLSVTALLG

SEQ ID NO: 8688 - protein, 15 aa, Homo Sapiens
ALLGNSLILFATITQ

SEQ ID NO: 8689 - protein, 15 aa, Homo Sapiens
LGNSLILFATITQPS

SEQ ID NO: 8690 - protein, 15 aa, Homo Sapiens
ILFATITQPSLHEPM

SEQ ID NO: 8691 - protein, 15 aa, Homo Sapiens
ATITQPSLHEPMYYF

SEQ ID NO: 8692 - protein, 15 aa, Homo Sapiens
PSLHEPMYYFLSMLS

SEQ ID NO: 8693 - protein, 15 aa, Homo Sapiens
SLHEPMYYFLSMLSA

SEQ ID NO: 8694 - protein, 15 aa, Homo Sapiens
EPMYYFLSMLSATDL

SEQ ID NO: 8695 - protein, 15 aa, Homo Sapiens
PMYYFLSMLSATDLG

SEQ ID NO: 8696 - protein, 15 aa, Homo Sapiens
STLQNITSTSIIFLL

SEQ ID NO: 8697 - protein, 15 aa, Homo Sapiens
ITSTSIIFLLTGVPG

SEQ ID NO: 8698 - protein, 15 aa, Homo Sapiens
TGVPGLEAFHTWISI

SEQ ID NO: 8699 - protein, 15 aa, Homo Sapiens
LILFATITQPSLHEP

SEQ ID NO: 8700 - protein, 15 aa, Homo Sapiens
TSTLQNITSTSIIFL

SEQ ID NO: 8701 - protein, 15 aa, Homo Sapiens
VPGLEAFHTWISIPF

SEQ ID NO: 8702 - protein, 15 aa, Homo Sapiens
GNSLILFATITQPSL

SEQ ID NO: 8703 - protein, 15 aa, Homo Sapiens
HEPMYYFLSMLSATD

SEQ ID NO: 8704 - protein, 15 aa, Homo Sapiens
FHTWISIPFCFLSVT

SEQ ID NO: 8705 - protein, 15 aa, Homo Sapiens
SIPFCFLSVTALLGN

SEQ ID NO: 8706 - protein, 15 aa, Homo Sapiens
EPMYYFLSMLSATDL

SEQ ID NO: 8707 - protein, 15 aa, Homo Sapiens
STSIIFLLTGVPGLE

SEQ ID NO: 8708 - protein, 15 aa, Homo Sapiens
IFLLTGVPGLEAFHT

SEQ ID NO: 8709 - protein, 15 aa, Homo Sapiens
LTGVPGLEAFHTWIS

SEQ ID NO: 8710 - protein, 15 aa, Homo Sapiens
FLSVTALLGNSLILF

SEQ ID NO: 8711 - protein, 15 aa, Homo Sapiens
SLILFATITQPSLHE

SEQ ID NO: 8712 - protein, 15 aa, Homo Sapiens
GVPGLEAFHTWISIP

SEQ ID NO: 8713 - protein, 15 aa, Homo Sapiens
ISIPFCFLSVTALLG

SEQ ID NO: 8714 - protein, 15 aa, Homo Sapiens
LSVTALLGNSLILFA

SEQ ID NO: 8715 - protein, 15 aa, Homo Sapiens
SIIFLLTGVPGLEAF

SEQ ID NO: 8716 - protein, 15 aa, Homo Sapiens
LEAFHTWISIPFCFL

SEQ ID NO: 8717 - protein, 15 aa, Homo Sapiens
PFCFLSVTALLGNSL

SEQ ID NO: 8718 - protein, 15 aa, Homo Sapiens
PMYYFLSMLSATDLG

SEQ ID NO: 8719 - protein, 15 aa, Homo Sapiens
LQNITSTSIIFLLTG

SEQ ID NO: 8720 - protein, 15 aa, Homo Sapiens
TSIIFLLTGVPGLEA

SEQ ID NO: 8721 - protein, 15 aa, Homo Sapiens
HTWISIPFCFLSVTA

SEQ ID NO: 8722 - protein, 15 aa, Homo Sapiens
WISIPFCFLSVTALL

SEQ ID NO: 8723 - protein, 15 aa, Homo Sapiens
FCFLSVTALLGNSLI

SEQ ID NO: 8724 - protein, 15 aa, Homo Sapiens
TALLGNSLILFATIT

SEQ ID NO: 8725 - protein, 15 aa, Homo Sapiens
NSLILFATITQPSLH

SEQ ID NO: 8726 - protein, 15 aa, Homo Sapiens
QPSLHEPMYYFLSML

SEQ ID NO: 8727 - protein, 15 aa, Homo Sapiens
ITSTLQNITSTSIIF

SEQ ID NO: 8728 - protein, 15 aa, Homo Sapiens
STLQNITSTSIIFLL

SEQ ID NO: 8729 - protein, 15 aa, Homo Sapiens
NITSTSIIFLLTGVP

SEQ ID NO: 8730 - protein, 15 aa, Homo Sapiens
TSTSIIFLLTGVPGL

SEQ ID NO: 8731 - protein, 15 aa, Homo Sapiens
TWISIPFCFLSVTAL

SEQ ID NO: 8732 - protein, 15 aa, Homo Sapiens
IPFCFLSVTALLGNS

SEQ ID NO: 8733 - protein, 15 aa, Homo Sapiens
CFLSVTALLGNSLIL

SEQ ID NO: 8734 - protein, 15 aa, Homo Sapiens
SVTALLGNSLILFAT

SEQ ID NO: 8735 - protein, 15 aa, Homo Sapiens
ALLGNSLILFATITQ

SEQ ID NO: 8736 - protein, 15 aa, Homo Sapiens
LLGNSLILFATITQP

SEQ ID NO: 8737 - protein, 15 aa, Homo Sapiens
LGNSLILFATITQPS

SEQ ID NO: 8738 - protein, 15 aa, Homo Sapiens
ATITQPSLHEPMYYF

SEQ ID NO: 8739 - protein, 15 aa, Homo Sapiens
IIFLLTGVPGLEAFH

SEQ ID NO: 8740 - protein, 15 aa, Homo Sapiens
VTALLGNSLILFATI

SEQ ID NO: 8741 - protein, 15 aa, Homo Sapiens
FATITQPSLHEPMYY

SEQ ID NO: 8742 - protein, 15 aa, Homo Sapiens
FITSTLQNITSTSII

SEQ ID NO: 8743 - protein, 15 aa, Homo Sapiens
TLQNITSTSIIFLLT

SEQ ID NO: 8744 - protein, 15 aa, Homo Sapiens
QNITSTSIIFLLTGV

SEQ ID NO: 8745 - protein, 15 aa, Homo Sapiens
ITSTSIIFLLTGVPG

SEQ ID NO: 8746 - protein, 15 aa, Homo Sapiens
TGVPGLEAFHTWISI

SEQ ID NO: 8747 - protein, 15 aa, Homo Sapiens
PGLEAFHTWISIPFC

SEQ ID NO: 8748 - protein, 15 aa, Homo Sapiens
EAFHTWISIPFCFLS

SEQ ID NO: 8749 - protein, 15 aa, Homo Sapiens
LFATITQPSLHEPMY

SEQ ID NO: 8750 - protein, 15 aa, Homo Sapiens
TITQPSLHEPMYYFL

SEQ ID NO: 8751 - protein, 15 aa, Homo Sapiens
TQPSLHEPMYYFLSM

SEQ ID NO: 8752 - protein, 15 aa, Homo Sapiens
PSLHEPMYYFLSMLS

SEQ ID NO: 8753 - protein, 15 aa, Homo Sapiens
SLHEPMYYFLSMLSA

SEQ ID NO: 8754 - protein, 15 aa, Homo Sapiens
LHEPMYYFLSMLSAT

SEQ ID NO: 8755 - protein, 15 aa, Homo Sapiens
PFCFLSVTALLGNSL

SEQ ID NO: 8756 - protein, 15 aa, Homo Sapiens
EPMYYFLSMLSATDL

SEQ ID NO: 8757 - protein, 15 aa, Homo Sapiens
IFLLTGVPGLEAFHT

SEQ ID NO: 8758 - protein, 15 aa, Homo Sapiens
STSIIFLLTGVPGLE

SEQ ID NO: 8759 - protein, 15 aa, Homo Sapiens
TSIIFLLTGVPGLEA

SEQ ID NO: 8760 - protein, 15 aa, Homo Sapiens
FHTWISIPFCFLSVT

SEQ ID NO: 8761 - protein, 15 aa, Homo Sapiens
SIPFCFLSVTALLGN

SEQ ID NO: 8762 - protein, 15 aa, Homo Sapiens
LILFATITQPSLHEP

SEQ ID NO: 8763 - protein, 15 aa, Homo Sapiens
FLSVTALLGNSLILF

SEQ ID NO: 8764 - protein, 15 aa, Homo Sapiens
FATITQPSLHEPMYY

SEQ ID NO: 8765 - protein, 15 aa, Homo Sapiens
VPGLEAFHTWISIPF

SEQ ID NO: 8766 - protein, 15 aa, Homo Sapiens
HTWISIPFCFLSVTA

SEQ ID NO: 8767 - protein, 15 aa, Homo Sapiens
SLILFATITQPSLHE

SEQ ID NO: 8768 - protein, 15 aa, Homo Sapiens
PSLHEPMYYFLSMLS

SEQ ID NO: 8769 - protein, 15 aa, Homo Sapiens
HEPMYYFLSMLSATD

SEQ ID NO: 8770 - protein, 15 aa, Homo Sapiens
TSTLQNITSTSIIFL

SEQ ID NO: 8771 - protein, 15 aa, Homo Sapiens
ITSTSIIFLLTGVPG

SEQ ID NO: 8772 - protein, 15 aa, Homo Sapiens
LTGVPGLEAFHTWIS

SEQ ID NO: 8773 - protein, 15 aa, Homo Sapiens
TALLGNSLILFATIT

SEQ ID NO: 8774 - protein, 15 aa, Homo Sapiens
NSLILFATITQPSLH

SEQ ID NO: 8775 - protein, 15 aa, Homo Sapiens
PMYYFLSMLSATDLG

SEQ ID NO: 8776 - protein, 15 aa, Homo Sapiens
SIIFLLTGVPGLEAF

SEQ ID NO: 8777 - protein, 15 aa, Homo Sapiens
LEAFHTWISIPFCFL

SEQ ID NO: 8778 - protein, 15 aa, Homo Sapiens
NITSTSIIFLLTGVP

SEQ ID NO: 8779 - protein, 15 aa, Homo Sapiens
IIFLLTGVPGLEAFH

SEQ ID NO: 8780 - protein, 15 aa, Homo Sapiens
LQNITSTSIIFLLTG

SEQ ID NO: 8781 - protein, 15 aa, Homo Sapiens
GVPGLEAFHTWISIP

SEQ ID NO: 8782 - protein, 15 aa, Homo Sapiens
GLEAFHTWISIPFCF

SEQ ID NO: 8783 - protein, 15 aa, Homo Sapiens
EAFHTWISIPFCFLS

SEQ ID NO: 8784 - protein, 15 aa, Homo Sapiens
ATITQPSLHEPMYYF

SEQ ID NO: 8785 - protein, 15 aa, Homo Sapiens
WISIPFCFLSVTALL

SEQ ID NO: 8786 - protein, 15 aa, Homo Sapiens
ISIPFCFLSVTALLG

SEQ ID NO: 8787 - protein, 15 aa, Homo Sapiens
FCFLSVTALLGNSLI

SEQ ID NO: 8788 - protein, 15 aa, Homo Sapiens
LSVTALLGNSLILFA

SEQ ID NO: 8789 - protein, 15 aa, Homo Sapiens
VTALLGNSLILFATI

SEQ ID NO: 8790 - protein, 15 aa, Homo Sapiens
LGNSLILFATITQPS

SEQ ID NO: 8791 - protein, 15 aa, Homo Sapiens
ITSTLQNITSTSIIF

SEQ ID NO: 8792 - protein, 15 aa, Homo Sapiens
CFLSVTALLGNSLIL

SEQ ID NO: 8793 - protein, 15 aa, Homo Sapiens
ALLGNSLILFATITQ

SEQ ID NO: 8794 - protein, 15 aa, Homo Sapiens
LLGNSLILFATITQP

SEQ ID NO: 8795 - protein, 15 aa, Homo Sapiens
GNSLILFATITQPSL

SEQ ID NO: 8796 - protein, 15 aa, Homo Sapiens
TITQPSLHEPMYYFL

SEQ ID NO: 8797 - protein, 15 aa, Homo Sapiens
QPSLHEPMYYFLSML

SEQ ID NO: 8798 - protein, 15 aa, Homo Sapiens
IPFCFLSVTALLGNS

SEQ ID NO: 8799 - protein, 15 aa, Homo Sapiens
ILFATITQPSLHEPM

SEQ ID NO: 8800 - protein, 15 aa, Homo Sapiens
FITSTLQNITSTSII

SEQ ID NO: 8801 - protein, 15 aa, Homo Sapiens
STLQNITSTSIIFLL

SEQ ID NO: 8802 - protein, 15 aa, Homo Sapiens
TLQNITSTSIIFLLT

SEQ ID NO: 8803 - protein, 15 aa, Homo Sapiens
QNITSTSIIFLLTGV

SEQ ID NO: 8804 - protein, 15 aa, Homo Sapiens
FLLTGVPGLEAFHTW

SEQ ID NO: 8805 - protein, 15 aa, Homo Sapiens
MIANTYLLTSPLMNP

SEQ ID NO: 8806 - protein, 15 aa, Homo Sapiens
IANTYLLTSPLMNPV

SEQ ID NO: 8807 - protein, 15 aa, Homo Sapiens
PAYVHTMIANTYLLT

SEQ ID NO: 8808 - protein, 15 aa, Homo Sapiens
AYVHTMIANTYLLTS

SEQ ID NO: 8809 - protein, 15 aa, Homo Sapiens
YVHTMIANTYLLTSP

SEQ ID NO: 8810 - protein, 15 aa, Homo Sapiens
ANTYLLTSPLMNPVI

SEQ ID NO: 8811 - protein, 15 aa, Homo Sapiens
TYLLTSPLMNPVIYS

SEQ ID NO: 8812 - protein, 15 aa, Homo Sapiens
HTMIANTYLLTSPLM

SEQ ID NO: 8813 - protein, 15 aa, Homo Sapiens
NTYLLTSPLMNPVIY

SEQ ID NO: 8814 - protein, 15 aa, Homo Sapiens
YLLTSPLMNPVIYSV

SEQ ID NO: 8815 - protein, 15 aa, Homo Sapiens
TSPLMNPVIYSVKTK

SEQ ID NO: 8816 - protein, 15 aa, Homo Sapiens
LLTSPLMNPVIYSVK

SEQ ID NO: 8817 - protein, 15 aa, Homo Sapiens
TMIANTYLLTSPLMN

SEQ ID NO: 8818 - protein, 15 aa, Homo Sapiens
LTSPLMNPVIYSVKT

SEQ ID NO: 8819 - protein, 15 aa, Homo Sapiens
VHTMIANTYLLTSPL

SEQ ID NO: 8820 - protein, 15 aa, Homo Sapiens
PAYVHTMIANTYLLT

SEQ ID NO: 8821 - protein, 15 aa, Homo Sapiens
AYVHTMIANTYLLTS

SEQ ID NO: 8822 - protein, 15 aa, Homo Sapiens
NTYLLTSPLMNPVIY

SEQ ID NO: 8823 - protein, 15 aa, Homo Sapiens
TYLLTSPLMNPVIYS

SEQ ID NO: 8824 - protein, 15 aa, Homo Sapiens
VHTMIANTYLLTSPL

SEQ ID NO: 8825 - protein, 15 aa, Homo Sapiens
HTMIANTYLLTSPLM

SEQ ID NO: 8826 - protein, 15 aa, Homo Sapiens
MIANTYLLTSPLMNP

SEQ ID NO: 8827 - protein, 15 aa, Homo Sapiens
LLTSPLMNPVIYSVK

SEQ ID NO: 8828 - protein, 15 aa, Homo Sapiens
TSPLMNPVIYSVKTK

SEQ ID NO: 8829 - protein, 15 aa, Homo Sapiens
YVHTMIANTYLLTSP

SEQ ID NO: 8830 - protein, 15 aa, Homo Sapiens
YLLTSPLMNPVIYSV

SEQ ID NO: 8831 - protein, 15 aa, Homo Sapiens
ANTYLLTSPLMNPVI

SEQ ID NO: 8832 - protein, 15 aa, Homo Sapiens
LTSPLMNPVIYSVKT

SEQ ID NO: 8833 - protein, 15 aa, Homo Sapiens
IANTYLLTSPLMNPV

SEQ ID NO: 8834 - protein, 15 aa, Homo Sapiens
TMIANTYLLTSPLMN

SEQ ID NO: 8835 - protein, 15 aa, Homo Sapiens
AYVHTMIANTYLLTS

SEQ ID NO: 8836 - protein, 15 aa, Homo Sapiens
YVHTMIANTYLLTSP

SEQ ID NO: 8837 - protein, 15 aa, Homo Sapiens
MIANTYLLTSPLMNP

SEQ ID NO: 8838 - protein, 15 aa, Homo Sapiens
IANTYLLTSPLMNPV

SEQ ID NO: 8839 - protein, 15 aa, Homo Sapiens
YLLTSPLMNPVIYSV

SEQ ID NO: 8840 - protein, 15 aa, Homo Sapiens
ANTYLLTSPLMNPVI

SEQ ID NO: 8841 - protein, 15 aa, Homo Sapiens
VHTMIANTYLLTSPL

SEQ ID NO: 8842 - protein, 15 aa, Homo Sapiens
HTMIANTYLLTSPLM

SEQ ID NO: 8843 - protein, 15 aa, Homo Sapiens
TYLLTSPLMNPVIYS

SEQ ID NO: 8844 - protein, 15 aa, Homo Sapiens
TSPLMNPVIYSVKTK

SEQ ID NO: 8845 - protein, 15 aa, Homo Sapiens
PAYVHTMIANTYLLT

SEQ ID NO: 8846 - protein, 15 aa, Homo Sapiens
NTYLLTSPLMNPVIY

SEQ ID NO: 8847 - protein, 15 aa, Homo Sapiens
LTSPLMNPVIYSVKT

SEQ ID NO: 8848 - protein, 15 aa, Homo Sapiens
PAYVHTMIANTYLLT

SEQ ID NO: 8849 - protein, 15 aa, Homo Sapiens
HTMIANTYLLTSPLM

SEQ ID NO: 8850 - protein, 15 aa, Homo Sapiens
NTYLLTSPLMNPVIY

SEQ ID NO: 8851 - protein, 15 aa, Homo Sapiens
ANTYLLTSPLMNPVI

SEQ ID NO: 8852 - protein, 15 aa, Homo Sapiens
AYVHTMIANTYLLTS

SEQ ID NO: 8853 - protein, 15 aa, Homo Sapiens
MIANTYLLTSPLMNP

SEQ ID NO: 8854 - protein, 15 aa, Homo Sapiens
TYLLTSPLMNPVIYS

SEQ ID NO: 8855 - protein, 15 aa, Homo Sapiens
TSPLMNPVIYSVKTK

SEQ ID NO: 8856 - protein, 15 aa, Homo Sapiens
VHTMIANTYLLTSPL

SEQ ID NO: 8857 - protein, 15 aa, Homo Sapiens
IANTYLLTSPLMNPV

SEQ ID NO: 8858 - protein, 15 aa, Homo Sapiens
YLLTSPLMNPVIYSV

SEQ ID NO: 8859 - protein, 15 aa, Homo Sapiens
LLTSPLMNPVIYSVK

SEQ ID NO: 8860 - protein, 15 aa, Homo Sapiens
TMIANTYLLTSPLMN

SEQ ID NO: 8861 - protein, 15 aa, Homo Sapiens
LTSPLMNPVIYSVKT

SEQ ID NO: 8862 - protein, 4 aa, Homo Sapiens
RKET

SEQ ID NO: 8863 - protein, 4 aa, Homo Sapiens
SATD

SEQ ID NO: 8864 - protein, 4 aa, Homo Sapiens
TVME

SEQ ID NO: 8865 - protein, 4 aa, Homo Sapiens
SCTD

SEQ ID NO: 8866 - protein, 4 aa, Homo Sapiens
SPEE

SEQ ID NO: 8867 - protein, 6 aa, Homo Sapiens
GLSIST

SEQ ID NO: 8868 - protein, 17 aa, Homo Sapiens
MESSVLLAMAFDRFVAV

SEQ ID NO: 8869 - DNA, 210 bp, Homo Sapiens
gatcaatacacaaatgaatgtagctttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatc

SEQ ID NO: 8870 - DNA, 3754 bp, Homo Sapiens
  CDS (2133)...(2897)
ccgccttccaggttcactccattctcctgcctcagcctccccagtagctggaactacaggcgcccgccaccacgcccggctaattttttgtatttttagtggagacgaggtttcaccatgttggccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttatataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtgacactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctccactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggtgggggcagcctcctgtcttcctaagcctggtgggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaaaaaaaaaaaa

SEQ ID NO: 8871 - protein, 254 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLISPLMNPVIYSVKTKQIRRAVIKILHSKET

SEQ ID NO: 8872 - DNA, 3754 bp, Homo Sapiens; identical to SEQ ID NO: 8870
  CDS (1947)...(2897)

SEQ ID NO: 8873 - protein, 316 aa, Homo Sapiens
FITSTLQNITSTSIIFLLTGVPGLEAFHTWISIPFCFLSVTALLGNSLILFATITQPSLHEPMYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLISPLMNPVIYSVKTKQIRRAVIKILHSKET

SEQ ID NO: 8874 - DNA, 3754 bp, Homo Sapiens
  CDS (2133)...(2897)
ccgccttccaggttcactccattctcctgcctcagcctccccagtagctggaactacaggcgcccgccaccacgcccggctaattttttgtatttttagtggagacgaggtttcaccatgttggccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttatataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtgacactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctccactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggtgggggcagcctcctgtcttcctaagcctggtgggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgacctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaaaaaaaaaaaa

SEQ ID NO: 8875 - protein, 254 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGKQAPAYVHTMIANTYLLTSPLMNPVIYSVKTKQIRRAVIKILHSKET

SEQ ID NO: 8876 - DNA, 3754 bp, Homo Sapiens; identical to SEQ ID NO: 8870
  CDS (2133)...(2897)

SEQ ID NO: 8877 - protein, 254 aa, Homo Sapiens; identical to SEQ ID NO: 8871

SEQ ID NO: 8878 - DNA, 3754 bp, Homo Sapiens
  CDS (2133)...(2897)
ccgccttccaggttcactccattctcctgcctcagcctccccagtagctggaactacaggcgcccgccaccacgcccggctaattttttgtatttttagtggagacgaggtttcaccatgttggccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttatataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtgacactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctccactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggtgggggcagcctcctgtcttcctaagcctggggggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaaaaaaaaaaaa

SEQ ID NO: 8879 - protein, 254 aa, Homo Sapiens; identical to SEQ ID NO: 8871

SEQ ID NO: 8880 - DNA, 3754 bp, Homo Sapiens
  CDS (2133)...(2897)
ccgccttccaggttcactccattctcctgcctcagcctccccagtagctggaactacaggcgcccgccaccacgcccggctaattttttgtatttttagtggagacgaggtttcaccatgttggccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttatataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtgacactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctccactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggggggggcagcctcctgtcttcctaagcctggtgggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaaaaaaaaaaaa

SEQ ID NO: 8881 - protein, 254 aa, Homo Sapiens; identical to SEQ ID NO: 8871

SEQ ID NO: 8882 - DNA, 3754 bp, Homo Sapiens
  CDS (2133)...(2897)
ccgccttccaggttcactccattctcctgcctcagcctccccagtagctggaactacaggcgcccgccaccacgcccggctaattttttgtatttttagtggagacgaggtttcaccatgttggccaggatggtctcgatctcctgacctcgtgatccgcccacctcggcctcccaaagtgctgggactacaggcgtgagccaccgcgcccagcctgctcaacacttttacacatgccgttctgaaagcctgggaattcttcgtctcaacttacataaaacacagaaatctttcaagcactgctttttctagaaagccttctccaaatactacaaacctactgaatgctctctttctggtaattcctttttagtgtgttttggtttttcaaaatcattttatcttatttctagttgacaaataatatggtatatatttgtggggtaaaatgtgatgttgttatacatgtatgcattgtggaatgaccaaatcaagctaattatcatatccatcacctcaaatatttatcatttctttgtgctgtgaacatttaaaattctctcttttagtttttttgaaatatactatacattaactataattcttatttctctaagaggtttgatcatacattttagatattttcatcactcgcctgaggacactgtcattactgtaaatttcagaatctaaagctatagtttcattatttggccaaatcgtgtaatctataatttcttgtttttcatctagttttctgttaattttagttaaatcacacccccaccccccctttttttttcactaagacttcttccggtgatccttgaggtgacactttatcagggtgaatgtgtgagtctggatacgttgaggttcctctccatcctctcttttgtcaacacttactgtcagccacccagcaccctttcttttcctctgaagaagttaccctgcaactggctctctctcattgattgagccctctgcagccacaaccctaatctctgtttttccctagacccccgtcttcaactcaaccatacccatctatctacctttctgcaattctccactctatgaaaaaagaaatgtgatgtttgcaataaagttatatttttccctccgaaacaaaacagtaacattcaattaggtatctcctaagaagtatgtcttaacaaaatagagagattctgttctggagaactagtcttccagcagactgaagagagaactgtgttggaacgtggcagcacattatatcaggtgggggcagcctcctgtcttcctaagcctggtgggaggtctgtgttctaaccatctcttccaaatatgatgccgggtatcatattgtaagggtttctttaatggttagatgctgaagccatttatttgtcacttcctatgtgttactttgtattataatgatctctttcttcatattttctggcttcccaaattgtctgtaagcttctctgctttccacacttatgaccaatgtaatattgctgttccacagccccagtgtatttttctctggtgccaaccatagaggaaaaataatgcactacctctttagcacaatttaaacatgccataaagaatgaaatatgattggcaaactcagggtaaagtgtttattcttagtttggttatctatggctagaacgatcagaggagtggtcacatgatataaacatagctgccagcaaagggccctagagaagaaagattgtacactaaggcaaattcaaaaacaaaccaaagtgcccactacagcagttgaaatctgacattttttaatcaatttaaatgagccattcatagtttcatattatataaatactcatcagttttctgtacaataaaattattttaattcgatcaatacacaaatgaatgtagcttttttttgtttaagctctcatctcgttctgtacttttaattcatcacgtcaactttgcagaatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataaaattgtagaattctagcactagatggacccctcaagatggtatacttcaggtcatgtttccaattaaaaacaaaaaacaaccaaagaactggtgcccattgaagctaagcacataatcatttaaagttaaagctggaatgtatctagaacatcagctagtttgactactttattttccagatgaggaggtgaagacatgggatggaagagatgaacagcctaaaattagccttatatataaaatttctccttctcacaccactgttgggtccaaactgttgttgccttctgtccctgccaacaccctttctgttattatctcatctacttcatagcctttagaatgacacattacagaaaagtcactcctttgtgagaaataggtagtattttccaactgttctagtaatttcgattgccatttattatttgctctgacaagtcatggttctaagtgttttttgtatgtattaacatattttatatctaaaacaatgttataagataatcactttaattatcaataagaaaattgaggcatgaaatgttaagtagcttgcttaaacagctagtaactggtgttgctgatggcagagcacatccatgcagactgactccagagtcccccacactcttaattttaatgttatattgctacctataatataatatataggtatataatttatatataatttatatttgtaaaaattatatgaacttatatatataaacttatatttataaattatgtacttatatgtgtaaattatatttatatttataaatataaatatagagagaagttcaggcaatttttactaggaaacataaagaagtaaaaaaaaaaaaaaaaa

SEQ ID NO: 8883 - protein, 254 aa, Homo Sapiens; identical to SEQ ID NO: 8871

SEQ ID NO: 8884 - protein, 254 aa, Homo Sapiens; identical to SEQ ID NO: 2418

SEQ ID NO: 8885 - protein, 316 aa, Homo Sapiens; identical to SEQ ID NO: 8873

SEQ ID NO: 8886 - protein, 254 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLTSPLMNPVIYSVKTKQIRRAVIKILHSKET

SEQ ID NO: 8887 - DNA, 912 bp, Homo Sapiens
cttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaa

SEQ ID NO: 8888 - DNA, 912 bp, Mus musculus
cttccatcattttcctgctcactggtgtgcccgggctggaagctttccacacctggatctccattcccttctgctttctctatgcaactgccctgtcagggaacagcctgattctctttgtcattatcacccagcccagcctccacgagcccatgtattacttcctctccatgctatccaccactgacctcgggctctccatctccactctggccaccatgctggggatattctggttcaacgccagggagatcagcttcaatgcctgcttgtcactgatgttcttcattaaactcttcactgtcatggaatcctcagtgctgttggctatggcttatgatcgttatgtggccatctccaaccctcttaggtatgccactattttaactgattccagaatagctcaaattggggtgacaattgtcatcagagggactgtaatgttgacaccgatggtcgcacttcttaagagactaaccttctgcagcagccgtgtgctccaccactcctactgtttccaccccgatgtcatgaagctctcatgcacagacaccaggatcaacaatgcagttggattgactgccatgatctctactgttggtgtggactcagtccttattctcctttcctacatcctgatcatcagaactgtcctcagcattgcttccccagaagagaggaagaaagccttcagcacgtgtatctcccatatcggggctgtagctatattctatattccattgatcagtttgtcctttgttcacagatttgggaaacgagctccaccctatgtacataccatgattgctaatacctacctgctgattcctcctgtcatgaaccccatcatctacagtgtgaagaccaaacagatacgtaaagctgtgataaaagttttccaatctaaagaaa

SEQ ID NO: 8889 - DNA, 906 bp, Homo Sapiens
cttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattcca

SEQ ID NO: 8890 - DNA, 906 bp, Mus musculus
cttccatcattttcctgctcactggtgtgcctgggctggaagccttccacacctggatctccattcccttctgctttctctatgcaactgccctgtcagggaacagcctgattctctttgtcattatcacccagcccagcctccatgagcccatgtgttatttcctctctatgctgtccaccactgacctcgggctctccatctccactctggccaccatgctggggatattctggttcaacgccagagagatcagcttcaatgcttgcttgtcacaaatgttctttattcaactcttcactgtcatggaatcctcagtgctgttggctatggcttttgatcgttatgtggccatctccaaccctcttaggtatgcttcggtcttaactgaccttaaaatagctcagattggagtagcaattgttaccaggggcacactgatactgactcctatggttgtccttcttaaaagattatcctactgtagcagccatgtgcttcatcactcctactgtttccaccctgatgtcatgaagctctcatgcacagacaccaggatcaacagtgcagttgggctcactgccctgatctccactgctggagttgactctgtcttcatcatcctctcctatgtcctgatcatcagaactgtcctcagcattgcttccccagaagagaggaagaaagccttcagcacgtgtatctcccatattggggctgtggctgtgttctatattccactgattagtctgtcctttgtccacagatttgggaaacgagctccgccatatgtccatactctgattgccaatgcctacctgctgatccctcctgtcatgaaccccatcatctacagtgtgaagaccaagaagatacggaaggctgtgttgaaagttttccattcca

SEQ ID NO: 8891 - protein, 253 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLISPLMNPVIYSVKTKQIRRAVIKILHSKE

SEQ ID NO: 8892 - protein, 253 aa, Mus musculus
MYYFLSMLSTTDLGLSISTLATMLGIFWFNAREISFNACLSLMFFIKLFTVMESSVLLAMAYDRYVAISNPLRYATILTDSRIAQIGVTIVIRGTVMLTPMVALLKRLTFCSSRVLHHSYCFHPDVMKLSCTDTRINNAVGLTAMISTVGVDSVLILLSYILIIRTVLSIASPEERKKAFSTCISHIGAVAIFYIPLISLSFVHRFGKRAPPYVHTMIANTYLLIPPVMNPIIYSVKTKQIRKAVIKVFQSKE

SEQ ID NO: 8893 - protein, 250 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLISPLMNPVIYSVKTKQIRRAVIKILH

SEQ ID NO: 8894 - protein, 249 aa, Homo Sapiens
MYIFLCMLSGIDILISTSSMPKMLAIFWFNSTTIQFDACLLQIFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFH

SEQ ID NO: 8895 - protein, 252 aa, Homo Sapiens
MYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLISPLMNPVIYSVKTKQIRRAVIKILHSK

SEQ ID NO: 8896 - protein, 252 aa, Homo Sapiens
MYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQK

SEQ ID NO: 8897 - protein, 254 aa, Homo Sapiens; identical to SEQ ID NO: 2418

SEQ ID NO: 8898 - protein, 316 aa, Homo Sapiens
FITSTLQNITSTSIIFLLTGVPGLEAFHTWISIPFCFLSVTALLGNSLILFATITQPSLHEPMYYFLSMLSATDLGLSISTLVTMLSIFWFNVREISFNACLSHMFFIKFFTVMESSVLLAMAFDRFVAVSNPLRYAMILTDSRIAQIGVASVIRGLLMLTPMVALLIRLSYCHSQVLHHSYCYHPDVMKLSCTDTRINSAVGLTAMFSTVGVDLLLILLSYVLIIRTVLSVASPEERKETFSTCVSHIVAFAIYYIPLISLSIVHRFGPQAPAYVHTMIANTYLLISPLMNPVIYSVKTKQIRRAVIKILHSKET

SEQ ID NO: 8899 - protein, 254 aa, Homo Sapiens; identical to SEQ ID NO: 8886

SEQ ID NO: 8900 - skipped

SEQ ID NO: 8901 - protein, 254 aa, Homo Sapiens; identical to SEQ ID NO: 2418

SEQ ID NO: 8902 - protein, 316 aa, Homo Sapiens; identical to SEQ ID NO: 8898

SEQ ID NO: 8903 - protein, 10 aa, Homo Sapiens
GNSLILFATI

SEQ ID NO: 8904 - protein, 10 aa, Homo Sapiens
VPGLEAFHTW

SEQ ID NO: 8905 - protein, 10 aa, Homo Sapiens
TGVPGLEAFH

SEQ ID NO: 8906 - protein, 10 aa, Homo Sapiens
IPFCFLSVTA

SEQ ID NO: 8907 - protein, 10 aa, Homo Sapiens
PGLEAFHTWI

SEQ ID NO: 8908 - protein, 10 aa, Homo Sapiens
LEAFHTWISI

SEQ ID NO: 8909 - protein, 10 aa, Homo Sapiens
LQNITSTSII

SEQ ID NO: 8910 - protein, 10 aa, Homo Sapiens
FATITQPSLH

SEQ ID NO: 8911 - protein, 10 aa, Homo Sapiens
PMYYFLSMLS

SEQ ID NO: 8912 - protein, 9 aa, Homo Sapiens
YLLISPLMN

SEQ ID NO: 8913 - protein, 9 aa, Homo Sapiens
STLVTMLSI

The invention claimed is:

1. A composition comprising an isolated 238P1B2 protein comprising the amino acid sequence of SEQ ID NO:8873.

2. The composition of claim 1, further comprising a pharmaceutically acceptable carrier.

3. A pharmaceutical composition that comprises the composition of claim 1 in a human unit dose form.

* * * * *